(12) United States Patent
Oakes et al.

(10) Patent No.: US 11,560,555 B2
(45) Date of Patent: *Jan. 24, 2023

(54) ENGINEERED PROTEINS

(71) Applicant: Scribe Therapeutics Inc., Alameda, CA (US)

(72) Inventors: Benjamin Oakes, El Cerrito, CA (US); Sean Higgins, Alameda, CA (US); Hannah Spinner, Boston, MA (US); Sarah Denny, San Francisco, CA (US); Brett T. Staahl, Tiburon, CA (US); Kian Taylor, Atlanta, GA (US); Katherine Baney, Berkeley, CA (US); Isabel Colin, Oakland, CA (US); Maroof Adil, Davis, CA (US)

(73) Assignee: Scribe Therapeutics Inc., Alameda, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/533,997

(22) Filed: Nov. 23, 2021

(65) Prior Publication Data

US 2022/0081681 A1 Mar. 17, 2022

Related U.S. Application Data

(63) Continuation of application No. PCT/US2020/036505, filed on Jun. 5, 2020.

(60) Provisional application No. 63/030,838, filed on May 27, 2020, provisional application No. 62/944,892, filed on Dec. 6, 2019, provisional application No. 62/858,750, filed on Jun. 7, 2019.

(51) Int. Cl.
| | | |
|---|---|---|
| *C12N 9/22* | (2006.01) | |
| *C12N 15/11* | (2006.01) | |
| *C12N 15/86* | (2006.01) | |
| *C12N 15/90* | (2006.01) | |

(52) U.S. Cl.
CPC ............... *C12N 9/22* (2013.01); *C12N 15/11* (2013.01); *C12N 15/86* (2013.01); *C12N 15/907* (2013.01); *C12N 2310/20* (2017.05); *C12N 2740/15043* (2013.01)

(58) Field of Classification Search
None
See application file for complete search history.

(56) References Cited

U.S. PATENT DOCUMENTS

| 5,405,783 A | 4/1995 | Pirrung et al. |
| 5,412,087 A | 5/1995 | Mcgail et al. |
| 5,445,934 A | 8/1995 | Fodor et al. |
| 5,695,937 A | 12/1997 | Kinzler et al. |
| 6,979,538 B2 | 12/2005 | Ladner et al. |
| 9,982,267 B2 | 5/2018 | Del'Guidice et al. |
| 10,253,365 B1 | 4/2019 | Doudna et al. |
| 10,570,415 B2 | 2/2020 | Doudna et al. |
| 2014/0068797 A1 | 3/2014 | Doudna et al. |
| 2014/0273226 A1 | 9/2014 | Wu |
| 2016/0208243 A1 | 7/2016 | Zhang et al. |
| 2017/0211142 A1 | 7/2017 | Smargon et al. |
| 2017/0233756 A1 | 8/2017 | Begemann et al. |
| 2017/0321198 A1 | 11/2017 | Severinov et al. |
| 2017/0369870 A1 | 12/2017 | Gill |
| 2018/0258424 A1 | 9/2018 | Greenberg |
| 2018/0346927 A1* | 12/2018 | Doudna ................... C12N 9/22 |
| 2018/0363009 A1 | 12/2018 | Doudna et al. |
| 2019/0276842 A1 | 9/2019 | Doudna et al. |
| 2019/0359973 A1 | 11/2019 | Kmiec et al. |
| 2020/0017879 A1 | 1/2020 | Doudna et al. |
| 2020/0224160 A1 | 7/2020 | Ding et al. |
| 2020/0407738 A1 | 12/2020 | Nagy |
| 2021/0115420 A1 | 4/2021 | Bauer et al. |
| 2021/0139892 A1 | 5/2021 | Wilson et al. |
| 2021/0166783 A1 | 6/2021 | Shmakov et al. |
| 2021/0284981 A1 | 9/2021 | Doudna et al. |
| 2021/0309981 A1 | 10/2021 | Doudna et al. |
| 2022/0090036 A1 | 3/2022 | Oakes et al. |
| 2022/0220508 A1 | 7/2022 | Oakes et al. |

FOREIGN PATENT DOCUMENTS

| WO | WO-2010/054007 A1 | 5/2010 |
| WO | WO-2010/075303 A1 | 7/2010 |
| WO | WO-2012/068627 A1 | 5/2012 |
| WO | WO-2017/106569 A1 | 6/2017 |
| WO | WO-2018/064371 A1 | 4/2018 |
| WO | WO-2018/172556 A1 | 9/2018 |
| WO | WO-2018/195555 A1 | 10/2018 |
| WO | WO-2019/084148 A1 | 5/2019 |
| WO | WO-2019/168950 A1 | 9/2019 |

(Continued)

OTHER PUBLICATIONS

Aguilera, T.A. et al. (Jun. 2009). "Systemic in vivo distribution of activatable cell penetrating peptides is superior to that of cell penetrating peptides," Integr. Biol. (Camb) 1(5-6):371-381. Published online May 11, 2009.

Altschul, S.F. et al., (Oct. 1990). "Basic local alignment, search tool," J. Mol. Biol. 215:403-410.

Buenrostro, J.D, et al. (2014). "Quantitative analysis of RNA-protein interactions on a massively parallel array reveals biophysical and evolutionary landscapes," Nat. Biotechnol. 32:562-568, 19 pages provided.

Burstein, D. et al. (Feb. 2017). "New CRISPR-Cas systems from uncultivated microbes," Nature 542:237-241. with Supplemental Materials, 28 total pages.

Chen, B. et al. (Dec. 2003). "influence of histidine on the stability and physical properties of a fully human antibody in aqueous and solid forms," Pharm. Res. 20:1952-1960.

(Continued)

*Primary Examiner* — Nancy J Leith
(74) *Attorney, Agent, or Firm* — Cooley LLP

(57) ABSTRACT

Provided herein are engineered proteins comprising a RuvC DNA cleavage domain comprising one or more amino acid modifications, and one or more improved characteristics, relative to a naturally occurring RuvC domain. Also provided are gene editing systems comprising engineered proteins, and methods for use thereof.

25 Claims, 110 Drawing Sheets

Specification includes a Sequence Listing.

(56) References Cited

FOREIGN PATENT DOCUMENTS

| WO | WO-2020/023529 A1 | 1/2020 |
| WO | WO-2020/041456 A1 | 2/2020 |
| WO | WO-2020/247882 A1 | 12/2020 |
| WO | WO-2020/247883 A2 | 12/2020 |
| WO | WO-2020/247883 A3 | 12/2020 |
| WO | WO-2021/007177 A1 | 1/2021 |
| WO | WO-2021/025999 A1 | 2/2021 |
| WO | WO-2021/084533 A1 | 5/2021 |
| WO | WO-2021/113769 A1 | 6/2021 |
| WO | WO-2021/113772 A1 | 6/2021 |
| WO | WO-2021/188729 A1 | 9/2021 |
| WO | WO-2022/120095 A1 | 6/2022 |

OTHER PUBLICATIONS

Ghirlando, R. et al. (May 1999). "Glycosylation of human IgG-Fc: influences on structure revealed by differential scanning microcalorimetry," Immunil Letters 68:47-52.

International Search Report dated Nov. 10, 2020, for PCT Application No. PCT/US2020/036505, filed on Jun. 5, 2020, 8 pages.

International Search Report dated Nov. 24, 2020, for PCT Application No. PCT/US2020/036506, filed on Jun. 5, 2020, 5 pages.

International Search Report dated Mar. 30, 2022, for PCT Application No. PCT/US2021/061673, filed on Dec. 2, 2021, 6 pages.

Jarmoskaite, I. et al. (Jun. 2019). "A quantitative and predictive model for RNA binding by human pumilio proteins," Molecular Cell 74:966-981, 65 pages provided. Published online May 8, 2019.

Kiyama, R. et al. (Nov. 1996). "In vitro transcription of a poly(dA)-poly(dT)-containing sequence is inhibited by interaction between the template and its transcripts," Nucleic Acids Research 24:4577.

Kotin, R.M. (Jul. 1994). "Prospects for the use of adeno-associated vims as a vector for human gene therapy," Human Gene Therapy 5:793-801.

Liu, J.J. et al. (Feb. 2019). "CasX enzymes comprise a distinct family of RNA-guided genome 47 editors," Nature 566:218-223. Published online Feb. 4, 2019, 38 pages provided.

Liu, J.J et al. CasX enzymes comprise a distinct family of RNA-guided genome editors, Nature 568:E8-E10. (Author correction: published online Apr. 3, 2019).

Lorenz, R. et al. (Nov. 2011). "ViennaRNA Package 2.0," Algorithms for Molecular Biology 6:26, 14 pages. Published online Nov. 24, 2011.

Maeder, M.L. et al. (2019). "Development of a gene-editing approach to restore vision loss in Leber congenital amaurosis type 10," Nature Medicine 25:229-233. Published online Jan. 21, 2019.

Murray, A. et al. (Jul. 2002), "Epitope affinity chromatography and biophysical studies of monoclonal antibodies and recombinant antibody fragments," J. Chromatogr. Sci. 40:343-349.

Noguchi, H. et al. (Jul. 2003). "PDX-1 protein containing its own antennapedia-like protein transduction domain can transduce pancreatic duct and islet cells," Diabetes 52:1732-1737.

Oakes, B.L. et al. (Jun. 2016). "Profiling of engineering hotspots identifies an allosteric CRISPR-Cas9 switch," Nat. Biotechnol. 34:646-651, 14 pages provided. Published online May 2, 2016.

Qi, L.S. et al. (Feb. 2013). "Repurposing CRISPR as an RNA-guided platform for sequence-specific control of gene expression," Cell 152:1173-1183, 22 pages provided.

Smith, T.F. et al. (1981). "Comparison of biosequences," Adv. Appl. Math. 2:482-489.

Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.

Tuerk, C. et al. (Mar. 1988). "CUUCGG hairpins: extraordinarily stable RNA secondary structures associated with various biochemical processes," PNAS 85:1364-1368.

Wender, P.A. et al. (Nov. 2000). "The design, synthesis, and evaluation of molecules that enable or enhance cellular uptake: peptoid molecular transporters," PNAS 97:13003-13008.

Written Opinion of the International Searching Authority dated Nov. 10, 2020, for PCT Application No. PCT/US2020/036505, filed on Jun. 5, 2020, 19 pages.

Written Opinion of the International Searching Authority dated Nov. 24, 2020, for PCT Application No. PCT/US2020/036506, filed on Jun. 5, 2020, 8 pages.

Written Opinion of the International Searching Authority dated Mar. 30, 2022, for PCT Application No. PCT/US2021/061673, filed on Dec. 2, 2021, 11 pages.

Yang, H. et al. (May 2019). "CasX: a new and small CRISPR gene-editing protein," Cell Res. 29:345-82 346, Published online Apr. 16, 2019.

Yang, H. et al. (2016). "PAM-dependent target DNA recognition and cleavage by C2c1 CRISPR-Cas endonuclease," Cell 167:1814-1828, 31 pages provided.

Zender, L. et al. (Jun. 2002). "VP22-mediated intercellular transport of p53 in hepatoma cells in vitro and in vivo," Cancer Gene Ther. 9:489-496.

Zhang, J. et al. (Jun. 1997). "PowerBLAST: a new network BLAST application for interactive or automated sequence analysis and annotation," Genome Res. 7:649-656.

Zhao, H. et al. (Mar. 1998). "Molecular evolution by staggered extension process (StEP) in vitro recombination." Nature Biotechnol. 16:258-261.

Koonin, E.V. et al. (2019). "Origins and evolution of CRISPR-Cas systems," Philos. Trans. R. Soc. Lond. Biol. Sci. 374:20180087.

Makarova, K.S. et al. (2020). "Evolutionary classification of CRISPR-Cas systems: a burst of class 2 and derived variants," Nature Reviews Microbiology 18:67-83.

NCBI Reference Sequence, priority to Oct. 21, 2016, OHA03494.1, hypothetical protein A3J58_03210 [Candidatus Sungbacteria bacterium RIFCSPHIGHO2_02_FULL_52_23, 2 pages.

Shmakov, S. et al. (2017). "Diversity and evolution of class 2 CRISPR-Cas Systems," Nature Reviews Microbiology 15:169-182.

Stella, S. et al. (2017). "Class 2 CRISPR-Cas RNA-guided endonucleases: Swiss Army knives of genome editing," Nature Structural and Molecular Biology 24:882-892.

Yang, H. et al. (2017). "New CRISPR-Cas systems discovered," Cell Res. 27:313-314.

U.S. Appl. No. 17/641,404, filed Sep. 9, 2020, by Oakes et al. (Copy not attached).

U.S. Appl. No. 17/791,130, filed Jan. 8, 2021, by Oakes et al. (Copy not attached).

U.S. Appl. No. 17/483,681, filed Sep. 23, 2021, by Oakes et al. (Copy not attached).

U.S. Appl. No. 17/780,945, filed Dec. 4, 2020, by Oakes et al. (Copy not attached).

U.S. Appl. No. 17/829,206, filed May 31, 2022, by Oakes et al. (Copy not attached).

U.S. Appl. No. 17/828,957, filed Dec. 4, 2020, by Oakes et al. (Copy not attached).

\* cited by examiner

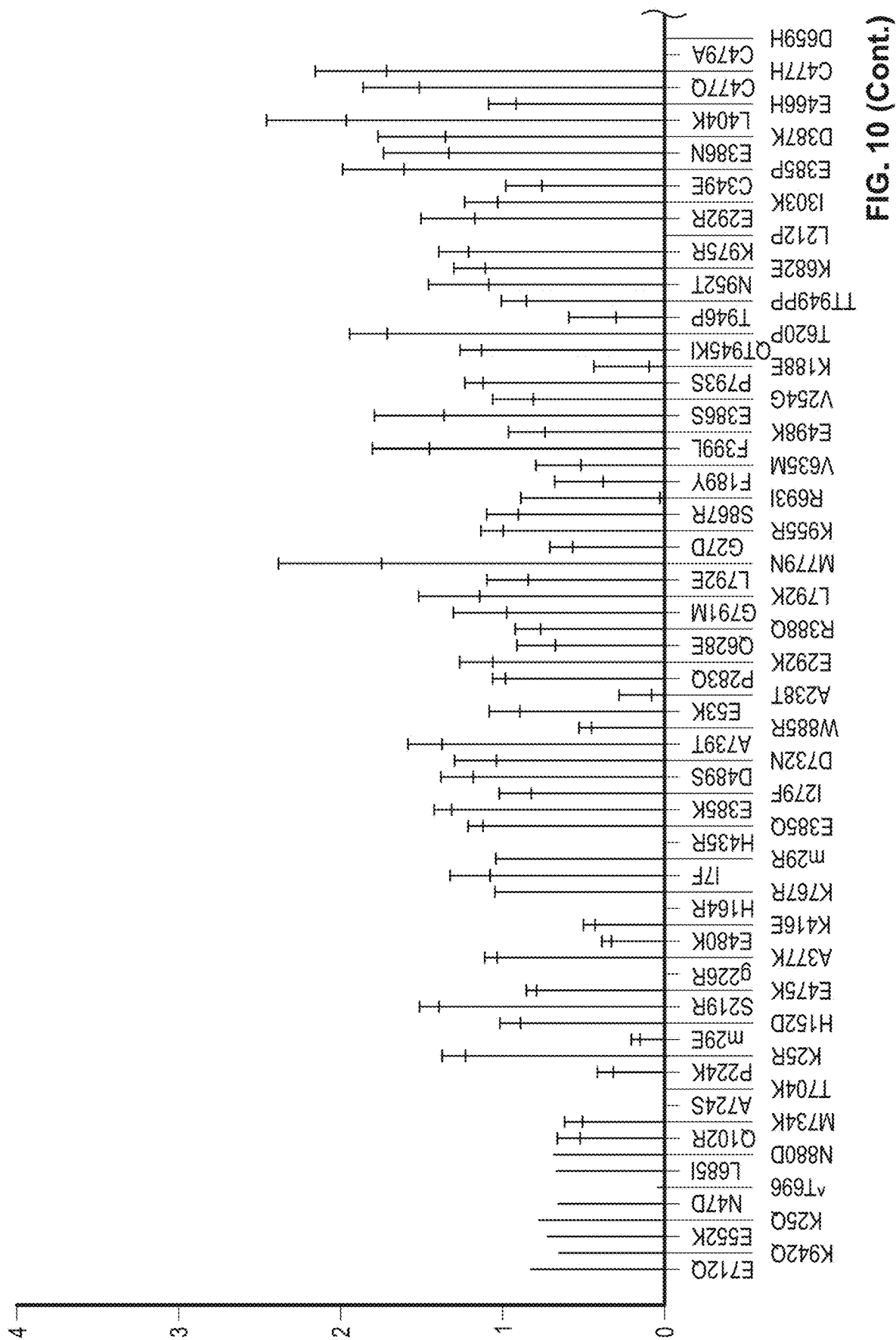

[P793] In loop

A708K
facing gRNA 5' end + salt bridge to gRNA

C477K
Facing the gRNA, salt bridge to gRNAbb spacer region at base ~14, gets rid of surface exposed Cys L379R
Salt bridge to target DNAbb towards 22-23 base

[P793]+ A708K (a combination)
Effects are additive and single mutants can be combined
for even greater improvements

[P793]+ A708K (a combination)
Effects are additive and single mutants can be combined
for even greater improvements

FIG. 21

Alignment of Reference CasX Proteins
SEQ ID NO: 1 and SEQ ID NO: 2
With Annotated Domains

```
                          56
SEQ_ID_NO:1  ---MEKRINKIRKKLSADNATKPVSRGPMKTLLVRVMTDDLKKRLEKRRKKPEVMPQVIS  58
SEQ_ID_NO:2  MQEIKRINKIRRRLVKDSNTKKAGKTGPMKTLLVRVMTPDLRERLENLRKKPENIPQPIS  60
             :  *:******:*: .::.*.*: .:*******.* *::**:*.***:*:*** ::

100
SEQ_ID_NO:1  NNAANNLRMLLDDYTKMKEAILQVYWQEFKDDHVGLMCKFAQPASKKIDQNKLKPEMDEK  118  ┌─────────┐
SEQ_ID_NO:2  NTSRANLNKLLTDYTKMKEAILHVYWEEFQKDPVGLMSRVAQPAPKNIDQRKLIPVKDGN  120  │  NTSB   │
             * :.**:. :* ********:***:**:.* ****.:.****.*:***.:* * :*.    │ Domain  │
                                                              102   └─────────┘
SEQ_ID_NO:1  GNLTTAGFACSQCGQPLFVYKLEQVSEKGKAYTNYFGRCNVAEHEKLILLAQLKPEKDSD  178
SEQ_ID_NO:2  ERLTSSGFACSQCCQPLYVYKLEQVVYKLEQVNDKGKPHTNYFGRCNVSEHERLILLSPHKPEA-ND  179
                                                      191
SEQ_ID_NO:1  EAVTYSLGKFGQRALDFYSIHVTKESTHPVKPLAQIAGNRYASGPVGKALSDACMGTIAS  238  ┌─────────┐
SEQ_ID_NO:2  ELVTYSLGKFGQRALDFYSIHVTRESNHPVKPLEQIGGNSCASGPVGKALSDACMGAVAS  239  │ Helical │
             * *********************.** .*****:**.** .*************:.**   │    I    │
                                                      192              │ Domain  │
                                                                       └─────────┘
SEQ_ID_NO:1  FLSKYQDIIIEHQKVKGNQKRLESLRELAGKENLEYPSVTLPPQPHTKEGVDAYNEVIA  298
SEQ_ID_NO:2  FLTKYQDIILEHQKVIKKNEKRLANLKDIASANGLAFPKITLPPQPHTKEGIEAYNNVVA  299
             **:*****::***** :::*:***.* :*..:.:*  *.:******** :*** *:*

SEQ_ID_NO:1  RVRMWVNLNLWQKLKLSRDDAKPLLRLKGFPSFPVVERRENEVDWWNTINEVKKLIDAKR  358  ┌─────────┐
SEQ_ID_NO:2  QIVIWVNLNLWQKLKLKIGRDEAKPLQRLKGFPSFPLVERQANEVDWWDMVCNVKKLINEKK  359  │ Helical │
                                                                              │   II    │
                                          332                                 │ Domain  │
                                          333                                 └─────────┘

SEQ_ID_NO:1  DMGRVFWSGVTAEKRNTILEGYNYLPNENDHKKREGSLENPKKPAKRQFGDLLLYLEKKY  418
SEQ_ID_NO:2  EDGKVFWQNLAGYKRQEALLPY--LSSEEDR------------KKGKKFARYQFGDLLLHLEKKH  410
```

| | | |
|---|---|---|
| SEQ_ID_NO: 1<br>SEQ_ID_NO: 2 | AGDWGKVFDEAWERIDKKTIAGLTSHIEREEARNAEDAQSKAVLTDWLRAKASFVLERLKE<br>GEDWGKVFDEAWERIDKKVEGLSKHIKLEEERRSEBAQSKAALIDWLRAKASFVIEGLKE | 478<br>470 |

OBD Domain

| | | |
|---|---|---|
| SEQ_ID_NO: 1<br>SEQ_ID_NO: 2 | MDEKEFYACEIQLQKWYGDLRGNPFAVEAENRVVDISGFSIGSDGHSIQYRNLLAWKYLE<br>ADKDEFCRCELKLQKWYGDLRGKPFATEAENSILDISGFSK------QYNCAFIWQKDG | 538<br>523 |
| SEQ_ID_NO: 1<br>SEQ_ID_NO: 2 | NGKREFYVLLMNYGKKGRIRFTDGTDI--KKSGKWQGLLYGGGKAKVIDLTFDPDDEQLIT<br>VKKLNLYLIINYFKGGKLRFKKIKPEAFEANRFYTVINKKSGEIVPMEVNFNFDDPNLII. | 596<br>583 |
| SEQ_ID_NO: 1<br>SEQ_ID_NO: 2 | LPLAFGTRQGREFIWNDLLSLETGIKLANGRVIEKTIYNKKIGRDEPALFVALTFERRE<br>LPLAFGKROGREFIWNDLLSLETGSLKLANGRVIEKTLYNRRTRQDEPALFVALFERRE | 656<br>643 |

RuvC Domain

| | | |
|---|---|---|
| SEQ_ID_NO: 1<br>SEQ_ID_NO: 2 | VVDPSNIKPVNLIGVDRGENIPAVIALTDPEGCPLPEFKDSGGPTDILRIGEGYKEKQR<br>VLDSSNIKPMNLIGIDRGENIPAVIALTDPEGCPLSRFKDSLGNPTHILRIGESYKEKQR | 716<br>703 |
| SEQ_ID_NO: 1<br>SEQ_ID_NO: 2 | ATQAAKEVEQRRAGGYSRKFASKSRNLADDMVRNSARDLFYHAVTHDAVLFENLSRGFG<br>TIQAAKEVEQRRAGGYSRKYASKAKNLADDMVRNTARDLLYAVTQDAMLIFENLSRGFG | 776<br>763 |
| SEQ_ID_NO: 1<br>SEQ_ID_NO: 2 | RQGKRTFMTERQYTKMEDWLTAKLAYEGLTSKTYLSKTLAQVTSKTCSNCGFTITTADYD<br>RQGKRTFMAERQYTRMEDWLTAKLAYEGLPSKTYLSKTLAQVTSKTCSNCGFTITSADYD | 836<br>823 |

TSL Domain

| | | |
|---|---|---|
| SEQ_ID_NO: 1<br>SEQ_ID_NO: 2 | GMLVRLKKTSDGWATTLNNKELKAEGQITYYNRYKRQTVEKELSAELDRLSEESGNNDIS<br>RVLEKLKLKTATGWMTTINGKELKVEGQITYYNRYKRQNVVKDLSVELDRLSEESVNNDIS | 896<br>883 |
| SEQ_ID_NO: 1<br>SEQ_ID_NO: 2 | KWITKGRRDEALFLLKKRFSHRPVQEOFVCLDCGHEVHADEQAALNIARSWLFLNSNSTEF<br>SWTKGRSGEALSLLKKRFSHRPVQEKFVCLNCGFETHADEQAALNIARSWLFLRSQE--Y | 956<br>941 |
| SEQ_ID_NO: 1<br>SEQ_ID_NO: 2 | KSY----KSGKQPFVGAWQAFYKRRLKEVWKPNA<br>KKYQTNKTTGNTDKRAFVETWQSFYRRKLKEVWKPAV | 986<br>978 |

FIG. 21 (Cont.)

ENGINEERED PROTEINS

CROSS REFERENCE TO RELATED APPLICATIONS

This application is a continuation of International Patent Application No. PCT/US2020/036505, filed on Jun. 5, 2020, which claims priority to U.S. Provisional Patent Application Nos. 62/858,750, filed on Jun. 7, 2019, 62/944,892, filed on Dec. 6, 2019 and 63/030,838, filed on May 27, 2020, the contents of each of which are incorporated herein by reference in their entireties.

INCORPORATION BY REFERENCE OF SEQUENCE LISTING

This application contains a Sequence listing which has been submitted in ASCII format via EFS-WEB and is hereby incorporated by reference in its entirety. Said ASCII copy, created on Nov. 4, 2021 is named SCRB_011_04US_SeqList_ST25 and is 3.8 MB in size.

BACKGROUND

The CRISPR-Cas systems confer bacteria and archaea with acquired immunity against phage and viruses. Intensive research over the past decade has uncovered the biochemistry of these systems. CRISPR-Cas systems consist of Cas proteins, which are involved in acquisition, targeting and cleavage of foreign DNA or RNA, and a CRISPR array, which includes direct repeats flanking short spacer sequences that guide Cas proteins to their targets. Class 2 CRISPR-Cas are streamlined versions in which a single Cas protein bound to RNA is responsible for binding to and cleavage of a targeted sequence. The programmable nature of these minimal systems has facilitated their use as a versatile technology that is revolutionizing the field of genome manipulation.

To date, only a few Class 2 CRISPR/Cas systems have been discovered that have been widely used. Thus, there is a need in the art for additional Class 2 CRISPR/Cas systems (e.g., Cas protein plus guide RNA combinations) that have been optimized and/or offer improvements over earlier generation systems for utilization in a variety of therapeutic, diagnostic, and research applications.

SUMMARY

In some aspects, the present disclosure provides variants of a reference CasX nuclease protein, wherein the CasX variant is capable of forming a complex with a guide nucleic acid (NA), and wherein the complex can bind a target DNA, wherein the target DNA comprises non-target strand and a target strand, and wherein the CasX variant comprises at least one modification relative to a domain of the reference CasX and exhibits one or more improved characteristics as compared to the reference CasX protein. The domains of the reference CasX protein include: (a) a non-target strand binding (NTSB) domain that binds to the non-target strand of DNA, wherein the NTSB domain comprises a four-stranded beta sheet; (b) a target strand loading (TSL) domain that places the target DNA in a cleavage site of the CasX variant, the TSL domain comprising three positively charged amino acids, wherein the three positively charged amino acids bind to the target strand of DNA, (c) a helical I domain that interacts with both the target DNA and a spacer region of a guide NA, wherein the helical I domain comprises one or more alpha helices; (d) a helical II domain that interacts with both the target DNA and a scaffold stem of the guide NA; (e) an oligonucleotide binding domain (OBD) that binds a triplex region of the guide NA; and (f) a RuvC DNA cleavage domain.

In some aspects, the present disclosure provides variants of a reference guide nucleic acid (gNA) capable of binding a CasX protein, wherein the reference guide nucleic acid comprises at least one modification in a region compared to the reference guide nucleic acid sequence, and the variant exhibits one or more improved characteristics compared to the reference guide RNA. The regions of the scaffold of the gNA include: (a) an extended stem loop; (b) a scaffold stem loop; (c) a triplex; and (d) pseudoknot. In some cases, the scaffold stem of the variant gNA further comprises a bubble. In other cases, the scaffold of the variant gNA further comprises a triplex loop region. In other cases, the scaffold of the variant gNA further comprises a 5' unstructured region.

In some aspects, the present disclosure provides gene editing pairs comprising the CasX proteins and gNAs of any of the embodiments described herein.

In some aspects, the present disclosure provides polynucleotides and vectors encoding the CasX proteins, gNAs and gene editing pairs described herein. In some embodiments, the vectors are viral vectors such as an Adeno-Associated Viral (AAV) vector or a lentiviral vector. In other embodiments, the vectors are non-viral particles such as virus-like particles or nanoparticles.

In some aspects, the present disclosure provides cells comprising the polynucleotides, vectors, CasX proteins, gNAs and gene editing pairs described herein. In other aspects, the present disclosure provides cells comprising target DNA edited by the methods of editing embodiments described herein.

In some aspects, the present disclosure provides kits comprising the polynucleotides, vectors, CasX proteins, gNAs and gene editing pairs described herein.

In some aspects, the present disclosure provides methods of editing a target DNA, comprising contacting the target DNA with one or more of the gene editing pairs described herein, wherein the contacting results in editing of the target DNA.

In other aspects, the disclosure provides methods of treatment of a subject in need thereof, comprising administration of the gene editing pairs or vectors comprising or encoding the gene editing pairs of any of the embodiments described herein.

In another aspect, provided herein are gene editing pairs, compositions comprising gene editing pairs, or vectors comprising or encoding gene editing pairs, for use as a medicament.

In another aspect, provided herein are gene editing pairs, compositions comprising gene editing pairs, or vectors comprising or encoding gene editing pairs, for use in a method of treatment, wherein the method comprises editing or modifying a target DNA; optionally wherein the editing occurs in a subject having a mutation in an allele of a gene wherein the mutation causes a disease or disorder in the subject, preferably wherein the editing changes the mutation to a wild type allele of the gene or knocks down or knocks out an allele of a gene causing a disease or disorder in the subject.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 3A shows the effect of single base pair (single base) substitutions, double base pair (double base) substitutions, single base pair insertions, single base pair deletions, and a single base pair deletion plus at single base pair substitution at each position of the reference sgRNA shown at top. FIG. 3B shows the effect of double base pair insertions and a single base pair insertion plus a single base pair substitution at each position of the improved reference sgRNA. The reference sgRNA sequence of SEQ ID NO: 5 is shown at the top of FIG. 3A and bottom of FIG. 3B. In FIG. 3A and FIG. 3B, $Log_2$ fold enrichment of the variant in the DME library relative to the reference sgRNA following selection is indicated in grayscale. Enrichment is a proxy for activity, where greater enrichment is a more active molecule. The results show regions of the reference sgRNA that should not be mutated and key regions that are targeted for mutagenesis.

FIG. 5A shows the fold change in editing efficiency of a CasX sgRNA reference of SEQ ID NO: 4 and a variant of the reference which has a sequence of SEQ ID NO: 5, across 10 targets. When averaged across 10 targets, the editing efficiency of sgRNA SEQ ID NO: 5 improved 176% compared to SEQ ID NO: 4. FIG. 5B shows that further improvement of the sgRNA scaffold of SEQ ID NO: 5 is possible by swapping the extended stem loop sequence for additional sequences to generate the scaffolds whose sequences are shown in Table 2. Fold change in editing efficiency is shown on the Y-axis. FIG. 5C is a plot showing the fold improvement of sgNA variants (including a variant with SEQ ID NO: 17) generated by DME mutations normalized to SEQ ID NO: 5 as the CasX reference sgRNA. FIG. 5D is a plot showing the fold improvement of sgNA variants of sequences listed in Table 2, which were generated by appending ribozyme sequences to the reference sgRNA sequence, normalized to SEQ ID NO: 5 as the CasX reference sgRNA. FIG. 5E is a plot showing the fold improvement normalized to the SEQ ID NO: 5 reference sgRNA of variants created by both combining (stacking) scaffold stem mutations showing improved cleavage, DME mutations showing improved cleavage, and using ribozyme appendages showing improved cleavage. The resulting sgNA variants yield 2 fold or greater improvement in cleavage compared to SEQ ID NO: 5 in this assay. EGFP editing assays were performed with spacer target sequences of E6 and E7.

FIGS. 7A-7D show the effect of single amino acid substitutions. FIGS. 7E-7H show the effect of single amino acid insertions. FIG. 7I shows the effect of single amino acid deletions.

FIG. 8A shows the effect of single amino acid substitutions. FIG. 8B shows the effect of single amino acid insertions. FIG. 8C shows the effect of single amino acid deletions. For all of FIGS. 8A-8C, The Y-axis shows each possible substitution or insertion (from top to bottom: R, H, K, D, E, S, T, N, Q, C, G, P, A, I, L, M, F, W, Y or V; boxes indicate the amino acid identity of the reference protein), the X-axis shows the amino acid position in the reference CasX protein. $Log_2$ fold enrichment of the CasX variant protein relative to the reference CasX protein of SEQ ID NO: 2 in a DME library following enrichment is indicated in grayscale, where greater enrichment is a more active molecule. (*)s indicate active sites. Running this assay at 45° C. enriches for different variants than running the same assay at 37° C. (see FIGS. 7A-7I), thereby indicating which amino acid residues and changes are important for thermostability and folding.

FIG. 12A shows CasX protein and sgNAs that were assayed with the E6 spacer targeting GFP. FIG. 12B shows CasX protein and sgNAs that were assayed with the E7 spacer targeting GFP. iGFP stands for "inducible GFP."

FIG. 13A shows an RFP+ and GFP+ reporter in *E. coli* cells assayed for CRISPR interference repression of GFP with a reference nuclease dead CasX protein and sgNA. FIG. 13B shows the same reporter cells assayed for GFP repression with nuclease dead CasX variants screened from a DME library. FIG. 13C shows improved editing efficiency of a selected CasX protein and sgNA variant compared to the reference with 5 spacers targeting the endogenous B2M locus in HEK 293 human cells. The Y axis shows disruption in B2M staining by HLA1 antibody indicating gene disruption via CasX editing and indel formation. The improved CasX variants improved editing of this locus up to 81-fold over the reference in the case of guide spacer #43. CasX pairs with the reference sgRNA:protein pair of SEQ ID NO: 5 and SEQ ID NO: 2, and CasX variant protein of L379R+ A708K+[P793] of SEQ ID NO: 2, assayed with the sgNA variant with a truncated stem loop and a T10C substitution, which is encoded by a sequence of TACTGGCGCCTT-TATCTCATTACTTTGAGAGCCATCACCAGCGACTA-TGTCGTAT GGGTAAAGCGCTTACGGACTTCGGTC-CGTAAGAAGCATCAAAG (SEQ ID NO: 23), are indicated. The following spacer sequences were used: #9: GTGTAGTACAAGAGATAGAA (SEQ ID NO: 24); #14: TGAAGCTGACAGCATTCGGG (SEQ ID NO: 25); #20: tagATCGAGACATGTAAGCA (SEQ ID NO: 26); #37: GGCCGAGATGTCTCGCTCCG (SEQ ID NO: 27) and #43: AGGCCAGAAAGAGAGAGTAG (SEQ ID NO: 28).

FIG. 14A shows a deletion of P at 793 of SEQ ID NO: 2, with a deletion in a loop that may affect folding. FIG. 14B shows a replacement of Alanine (A) by Lysine (K) at position 708 of SEQ ID NO: 2. This mutation is facing the gNA 5' end plus a salt bridge to the gNA. FIG. 14C shows a replacement of Cysteine (C) by Lysine (K) at position 477 of SEQ ID NO: 2. This mutation is facing the gNA. There is salt bridge to the gNAbb (gNA phosphase backbone) at approximately base 14 that may be affected. This mutation removes a surface exposed cysteine. FIG. 14D shows a replacement of Leucine (L) with Arginine (R) at position 379 of SEQ ID NO: 2. There is a salt bridge to the target DNAbb (DNA phosphate backbone) towards base pairs 22-23 that may be affected. FIG. 14E shows one view of a combination of the deletion of P at 793 and the A708K substitution. FIG. 14F shows an alternate view, that shows that the effects of individual mutants are additive and single mutants can be combined (stacked) for even greater improvements. Arrows indicate the locations of mutations throughout FIG. 14A-14F.

FIG. 17A and FIG. 17D, *Streptococcus pyogenes* Cas9 (SpyCas9) was assayed with two different gNA spacers and a 5' PAM site (SEQ ID NOs: 34-65) and (SEQ ID NOs: 136-166) for its ability to edit templates with a target sequence complementary to the spacer sequence (arrow), or with 1, 2, 3 or 4 mutations in the target sequence relative to the spacer sequence. FIG. 17B and FIG. 17E, *Staphylococcus aureus* Cas9 (SauCas9) was assayed with two different gNA spacers and a 5' PAM site (SEQ ID NOs: 66-103) and (SEQ ID NOs: 167-204) for its ability to edit templates with a target sequence complementary to the spacer sequence (arrow), or with 1, 2, 3 or 4 mutations in the target sequence relative to the spacer sequence. FIG. 17C and FIG. 17F, the reference Plm CasX protein and sgNA scaffold pair was assayed with two different gNA spacers and a 3' PAM site (SEQ ID NOs: 104-135) and (SEQ ID NOs: 205-236) for its ability to edit templates with a target sequence complementary to the spacer sequence (arrow), or with 1, 2, 3 or 4 mutations in the target sequence relative to the spacer sequence. In all of FIG. 17A-17F, the X-axis shows the fraction of cells where gene editing at the target sequence occurred.

FIG. 20A shows that changing amino acids within a distance of 10 Angstroms (A) of the guide RNA to hydrophobic residues (A, V, I, L, M, F, Y, W) results in a significantly less active protein. FIG. 20B demonstrates that, in contrast, changing a residue within 10 A of the RNA to a positively charged amino acid (R, H, K) is likely to improve activity.

FIG. 21 illustrates an alignment of two reference CasX protein sequences (SEQ ID NO: 1, top; SEQ ID NO: 2, bottom), with domains annotated.

FIG. 59A shows the distribution of substitutions, deletions and insertions. FIG. 59B is a scatterplot showing the high reproducibility of variant representation in two separate library pools after the CRISPRi assay in the unsorted, naive population of cells. (Library pool D3 vs D2 are two different versions of the dCasX protein, and represent replicates of the CRISPRi assay.)

FIG. 60A depicts the CryoEM structure of Deltaproteobacteria CasX protein:sgRNA RNP complex (PDB id: 6YN2), including two stem loops, a pseudoknot, and a triplex. FIG. 60B depicts the secondary structure of the sgRNA was identified from the structure shown in (A) using the tool RNAPDBee 2.0 (rnapdbee.cs.put.poznan.pl/, using the tools 3DNA/DSSR, and using the VARNA visualization tool). RNA regions are indicated. Residues that were not evident in the PDB crystal structure file are indicated by plain-text letters (i.e., not encircled), and are not included in residue numbering.

FIG. 61A provides the sequence alignment between the single guide scaffold 1 (SEQ ID NO: 4) and scaffold 2 (SEQ ID NO: 5). FIG. 61B shows the predicted secondary structure of scaffold 1 (without the 5' ACAUCU bases which were not in the cryoEM structure). Prediction was done using RNAfold (v 2.1.7), using a constraint that was derived from the base-pairing observed in the cryoEM structure (see FIGS. 60A-60B). This constraint required the base pairs observed in the cryoEM structure to be formed, and required the bases involved in triplex formation to be unpaired. This structure has distinct base pairing from the lowest-energy predicted structure at the 5' end (i.e., the pseudoknot and triplex loop). FIG. 61C shows the predicted secondary structure of scaffold 2. Prediction was done for scaffold 1, using a similar constraint based on the sequence alignment.

FIG. 63A depicts substituted bases (A, T, G, or C; top to bottom), FIG. 63B depicts inserted bases (A, T, G, or C; top to bottom), and FIG. 63C depicts deletions at the individual nucleotide position (X-axis) across scaffold 2. Enrichment values were averaged across the three dead CasX versions, relative to the average WT value. Scaffolds with relative log 2 enrichment >0 are considered 'enriched', as they were more represented in the sorted population relative to the naive population than the wildtype scaffold was represented. Error bars represent the confidence interval across the three catalytically dead CasX experiments.

FIG. 68A shows a bar graph of cleavage activity of head-to-head comparisons of cleavage activity of the guide scaffolds with five different spacers in a plasmid lipofection assay at the GFP locus in HEK-GFP cells. FIG. 68B shows the sequence alignment between scaffold 2 and guide 174 (SEQ ID NO: 2238). Asterisks indicate point mutations, and the dotted box shows the entire extended stem swap.

DETAILED DESCRIPTION

Figure 1:
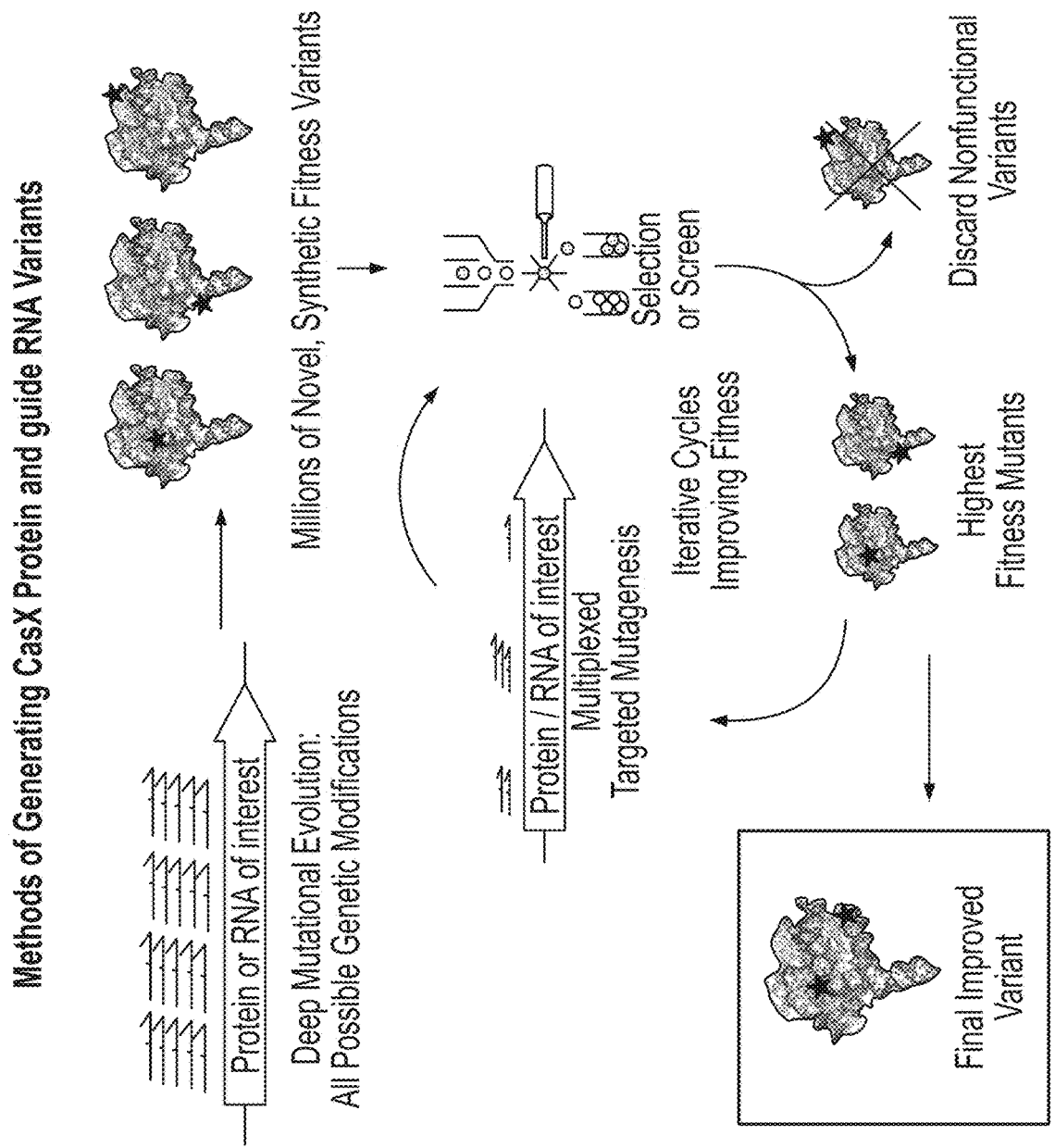
FIG. 1 is a diagram showing an exemplary method of making CasX protein and guide RNA variants of the disclosure using Deep Mutational Evolution (DME). In some exemplary embodiments, DME builds and tests nearly every possible mutation, insertion and deletion in a biomolecule and combinations/multiples thereof, and provides a near comprehensive and unbiased assessment of the fitness landscape of a biomolecule and paths in sequence space towards desired outcomes. As described herein, DME can be applied to both CasX protein and guide RNA.

While exemplary embodiments have been shown and described herein, it will be obvious to those skilled in the art that such embodiments are provided by way of example only. Numerous variations, changes, and substitutions will now occur to those skilled in the art without departing from the inventions claimed herein. It should be understood that various alternatives to the embodiments described herein may be employed in practicing the embodiments of the disclosure. It is intended that the claims define the scope of the invention and that methods and structures within the scope of these claims and their equivalents be covered thereby.

Definitions

Unless otherwise defined, all technical and scientific terms used herein have the same meaning as commonly understood by one of ordinary skill in the art to which this invention belongs. Although methods and materials similar or equivalent to those described herein can be used in the practice or testing of the present embodiments, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid to be specifically hybridizable; it can have at least about 70%, at least about 80%, or at least about 90%, or at least about 95% sequence identity and still hybridize to the target nucleic acid. Moreover, a polynucleotide may hybridize over one or more segments such that intervening or adjacent segments are not involved in the hybridization event (e.g., a loop structure or hairpin structure, a 'bulge', 'bubble' and the like).

A "gene," for the purposes of the present disclosure, includes a DNA region encoding a gene product (e.g., a protein, RNA), as well as all DNA regions which regulate the production of the gene product, whether or not such regulatory sequences are adjacent to coding and/or transcribed sequences. Accordingly, a gene may include regulatory sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed, e.g. the strand containing the coding sequence, as well as the complementary strand.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "regulatory element" is used interchangeably herein with the term "regulatory sequence," and is intended to include promoters, enhancers, and other expression regulatory elements (e.g. transcription termination signals, such as polyadenylation signals and poly-U sequences). Exemplary regulatory elements include a transcription promoter such as, but not limited to, CMV, CMV+intron A, SV40, RSV, HIV-Ltr, elongation factor 1 alpha (EF1α), MMLV-ltr, internal ribosome entry site (IRES) or P2A peptide to permit translation of multiple genes from a single transcript, metallothionein, a transcription enhancer element, a transcription termination signal, polyadenylation sequences, sequences for optimization of initiation of translation, and translation termination sequences. It will be understood that the choice of the appropriate regulatory element will depend on the encoded component to be expressed (e.g., protein or RNA) or whether the nucleic acid comprises multiple components that require different polymerases or are not intended to be expressed as a fusion protein.

The term "promoter" refers to a DNA sequence that contains an RNA polymerase binding site, transcription start site, TATA box, and/or B recognition element and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue-specific, inducible, etc.

The term "enhancer" refers to regulatory element DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such can be done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant polypeptide" or "recombinant protein" refers to a polypeptide or protein which is not naturally occurring, e.g., is made by the artificial combination of two otherwise separated segments of amino sequence through human intervention. Thus, e.g., a protein that comprises a heterologous amino acid sequence is recombinant.

As used herein, the term "contacting" means establishing a physical connection between two or more entities. For example, contacting a target nucleic acid with a guide nucleic acid means that the target nucleic acid and the guide nucleic acid are made to share a physical connection; e.g., can hybridize if the sequences share sequence similarity.

"Dissociation constant", or "$K_d$", are used interchangeably and mean the affinity between a ligand "L" and a protein "P"; i.e., how tightly a ligand binds to a particular protein. It can be calculated using the formula $K_d$=[L][P]/[LP], where [P], [L] and [LP] represent molar concentrations of the protein, ligand and complex, respectively.

The disclosure provides compositions and methods useful for editing a target nucleic acid sequence. As used herein "editing" is used interchangeably with "modifying" and includes but is not limited to cleaving, nicking, deleting, knocking in, knocking out, and the like.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor (e.g., such as the donor template) to the target. Homology-directed repair can result in an alteration of the sequence of the target nucleic acid sequence by insertion, deletion, or mutation if the donor template differs from the target DNA sequence and part or all of the sequence of the donor template is incorporated into the target DNA at the correct genomic locus.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in indels; the loss (deletion) or insertion of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break.

A polynucleotide or polypeptide (or protein) has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild-type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a wild-type or reference amino acid sequence or to a wild-type or reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., a cell line) cultured as a unicellular entity, which cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a composition, vector, cells, etc., that is capable of having any detectable, beneficial effect on any symptom, aspect, measured parameter or characteristics of a disease state or condition when administered in one or repeated doses to a subject. Such effect need not be absolute to be beneficial. Such effect can be transient.

As used herein, "administering" is meant as a method of giving a dosage of a composition of the disclosure to a subject.

As used herein, a "subject" is a mammal. Mammals include, but are not limited to, domesticated animals, primates, non-human primates, humans, dogs, porcine (pigs), rabbits, mice, rats and other rodents.

All publications, patents, and patent applications mentioned in this specification are herein incorporated by reference to the same extent as if each individual publication, patent, or patent application was specifically and individually indicated to be incorporated by reference.

I. General Methods

The practice of the present invention employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Harbor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the disclosure, which are, for clarity, described in the context of separate embodiments, may also be provided in combination in a single embodiment. In other cases, various features of the disclosure, which are, for brevity, described in the context of a single embodiment, may also be provided separately or in any suitable sub-combination. It is intended that all combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

II. CasX:gNA Systems

In a first aspect, the present disclosure provides CasX: gNA systems comprising a CasX protein and one or more guide nucleic acids (gNA) for use in modifying or editing a target nucleic acid, inclusive of coding and non-coding regions. The terms CasX protein and CasX are used interchangeably herein; the terms CasX variant protein and CasX variant are used interchangeably herein. The CasX protein and gNA of the CasX:gNA systems provided herein each independently may be a reference CasX protein, a CasX variant protein, a reference gNA, a gNA variant, or any combination of a reference CasX protein, reference gNA, CasX variant protein, or gNA variant. A gNA and a CasX protein, a gNA variant and CasX variant, or any combination thereof can form a complex and bind via non-covalent interactions, referred to herein as a ribonucleoprotein (RNP) complex. In some embodiments, the use of a pre-complexed CasX:gNA confers advantages in the delivery of the system components to a cell or target nucleic acid for editing of the target nucleic acid. In the RNP, the gNA can provide target specificity to the RNP complex by including a spacer sequence (targeting sequence) having a nucleotide sequence that is complementary to a sequence of a target nucleic acid. In the RNP, the CasX protein of the pre-complexed CasX: gNA provides the site-specific activity and is guided to a target site (and further stabilized at a target site) within a target nucleic acid sequence to be modified by virtue of its association with the gNA. The CasX protein of the RNP complex provides the site-specific activities of the complex such as binding, cleavage, or nicking of the target sequence by the CasX protein. Provided herein are compositions and cells comprising the reference CasX proteins, CasX variant proteins, reference gNAs, gNA variants, and CasX:gNA gene editing pairs of any combination of CasX and gNA, as well as delivery modalities comprising the CasX:gNA. In other embodiments, the disclosure provides vectors encoding or comprising the CasX:gNA pair and, optionally, donor templates for the production and/or delivery of the CasX: gNA systems. Also provided herein are methods of making CasX proteins and gNA, as well as methods of using the CasX and gNA, including methods of gene editing and methods of treatment. The CasX proteins and gNA components of the CasX:gNA and their features, as well as the delivery modalities and the methods of using the compositions are described more fully, below.

The donor templates of the CasX:gNA systems are designed depending on whether they are utilized to correct mutations in a target gene or insert a transgene at a different locus in the genome (a "knock-in"), or are utilized to disrupt the expression of a gene product that is aberrant; e.g., it comprises one or more mutations reducing expression of the gene product or rendering the protein dysfunctional (a "knock-down" or "knock-out"). In some embodiments, the donor template is a single stranded DNA template or a single stranded RNA template. In other embodiments, the donor template is a double stranded DNA template. In some embodiments, the CasX:gNA systems utilized in the editing of the target nucleic acid comprises a donor template having all or at least a portion of an open reading frame of a gene in the target nucleic acid for insertion of a corrective, wild-type sequence to correct a defective protein. In other cases, the donor template comprises all or a portion of a wild-type gene for insertion at a different locus in the genome for expression of the gene product. In still other cases, a portion of the gene can be inserted upstream ('5) of the mutation in the target nucleic acid, wherein the donor template gene portion spans to the C-terminus of the gene, resulting, upon its insertion into the target nucleic acid, in expression of the gene product. In other embodiments, the donor template can comprise one or more mutations in an encoding sequence compared to a normal, wild-type sequence of the target gene utilized for insertion for either knocking out or knocking down (described more fully, below) the defective target nucleic acid sequence. In other embodiments, the donor template can comprise regulatory elements, an intron, or an intron-exon junction having sequences specifically designed to knock-down or knock-out a defective gene or, in the alternative, to knock-in a corrective sequence to permit the expression of a functional gene product. In some embodiments, the donor polynucleotide comprises at least about 10, at least about 20, at least about 50, at least about 100, at least about 200, at least about 300, at least about 400, at least about 500, at least about 600, at least about 700, at least about 800, at least about 900, at least about 1000, at least about 10,000, at least about 15,000, at least about 25,000, at least about 50,000, at least about 100,000 or at least about 200,000 nucleotides. Provided that there are stretches of DNA sequence with sufficient numbers of nucleotides having sufficient homology flanking the cleavage site(s) of the target nucleic acid sequence targeted by the CasX:gNA (i.e., 5' and 3' to the cleavage site) to support homology-directed repair (the flanking regions being "homologous arms"), use of such donor templates can result in its integration into the target nucleic acid by HDR. In other cases, the donor template can be inserted by non-homologous end joining (NHEJ; which does not require homologous arms) or by microhomology-mediated end joining (MMEJ; which requires short regions of homology on the 5' and 3' ends). In some embodiments, the donor template comprises homologous arms on the 5' and 3' ends, each having at least about 2, at least about 10, at least about 20, at least about 30, at least about 50, at least about 100, at least about 150, at least about 300, at least about 1000, at least about 1500 or more nucleotides having homology with the sequences flanking the intended cleave site(s) of the target nucleic acid. In some embodiments, the CasX:gNA systems utilize two or more gNA with targeting sequences complementary to overlapping or different regions of the target nucleic acid such that the defective sequence can be excised by multiple double-stranded breaks or by nicking in locations flanking the defective sequence and the donor template inserted by HDR to replace the excised sequence. In the foregoing, the gNA would be designed to contain targeting sequences that are 5' and 3' to the individual site or sequence to be excised. By such appropriate selection of the targeting sequences of the gNA, defined regions of the target nucleic acid can be edited using the CasX:gNA systems described herein.

III. Guide Nucleic Acids of the CasX:gNA Systems

In other aspects, the disclosure provides guide nucleic acids (gNA) utilized in the CasX:gNA systems, and have utility in editing of a target nucleic acid. The present disclosure provides specifically-designed gNAs with targeting sequences (or "spacers") that are complementary to (and are therefore able to hybridize with) the target nucleic acid as a component of the gene editing CasX:gNA systems. It is envisioned that in some embodiments, multiple gNAs (e.g., multiple gRNAs) are delivered by the CasX:gNA system for the modification of different regions of a gene, including regulatory elements, an exon, an intron, or an intron-exon junction. In some embodiments, the targeting sequence of the gNA is complementary to a sequence comprising one or more single nucleotide polymorphisms (SNPs) of the target nucleic. In other embodiments, the targeting sequence of the gNA is complementary to a sequence of an intergenic region. For example, when a deletion of a protein-encoding gene is desired, a pair of gNAs with targeting sequences to different or overlapping regions of the target nucleic acid sequence can be used in order to bind and cleave at two different sites within the gene that can then be edited by indel formation or homology-directed repair (HDR), which, in the case of HDR, utilizes a donor template that is inserted to replace the deleted sequence to complete the editing.

a. Reference gNA and gNA Variants

In some embodiments, a gNA of the present disclosure comprises a sequence of a naturally-occurring gNA ("reference gNA"). In other cases, a reference gNA of the disclosure may be subjected to one or more mutagenesis methods, such as the mutagenesis methods described herein, which may include Deep Mutational Evolution (DME), deep mutational scanning (DMS), error prone PCR, cassette mutagenesis, random mutagenesis, staggered extension PCR, gene shuffling, or domain swapping, in order to generate one or more gNA variants with enhanced or varied properties relative to the reference gNA. gNA variants also include variants comprising one or more exogenous sequences, for example fused to either the 5' or 3' end, or inserted internally. The activity of reference gNAs may be used as a benchmark against which the activity of gNA variants are compared, thereby measuring improvements in function or other characteristics of the gNA variants. In other embodiments, a reference gNA may be subjected to one or more deliberate, targeted mutations in order to produce a gNA variant, for example a rationally-designed variant. As used herein, the terms gNA, gRNA, and gDNA cover naturally-occurring molecules (reference molecules), as well as sequence variants.

In some embodiments, the gNA is a deoxyribonucleic acid molecule ("gDNA"); in some embodiments, the gNA is a ribonucleic acid molecule ("gRNA"), and in other embodiments, the gNA is a chimera, and comprises both DNA and RNA.

The gNAs of the disclosure comprise two segments; a targeting sequence and a protein-binding segment (which constitutes the scaffold, discussed herein). The targeting segment of a gNA includes a nucleotide sequence (referred to interchangeably herein as a guide sequence, a spacer, a targeting sequence, or a targeting region) that is complementary to (and therefore hybridizes with) a specific sequence (a target site) within the target nucleic acid sequence (e.g., a target ssRNA, a target ssDNA, the complementary strand of a double stranded target DNA, etc.), described more fully below.

The targeting sequence of a gNA is capable of binding to a target nucleic acid sequence, including a coding sequence, a complement of a coding sequence, a non-coding sequence, and to regulatory elements. The protein-binding segment (or "protein-binding sequence") interacts with (e.g., binds to) a CasX protein. The protein-binding segment is alternatively referred to herein as a "scaffold". In some embodiments, the targeting sequence and scaffold each include complementary stretches of nucleotides that hybridize to one another to form a double stranded duplex (e.g. dsRNA duplex for a gRNA). Site-specific binding and/or cleavage of a target nucleic acid sequence (e.g., genomic DNA) by the CasX:gNA can occur at one or more locations of a target nucleic acid, determined by base-pairing complementarity between the targeting sequence of the gNA and the target nucleic acid sequence.

The gNA provides target specificity to the complex by having a nucleotide sequence that is complementary to a target sequence of a target nucleic acid. The CasX of the complex provides the site-specific activities of the complex such as binding, cleavage, or nicking of the target sequence of the target nucleic acid by the CasX nuclease and/or an activity provided by a fusion partner in case of a CasX containing fusion protein, described below. In some embodiments, the disclosure provides gene editing pairs of a CasX and gNA of any of the embodiments described herein that are capable of being bound together prior to their use for gene editing and, thus, are "pre-complexed" as the RNP. The use of a pre-complexed RNP confers advantages in the delivery of the system components to a cell or target nucleic acid sequence for editing of the target nucleic acid sequence. The CasX protein of the RNP provides the site-specific activity that is guided to a target site (e.g., stabilized at a target site) within a target nucleic acid sequence by virtue of its association with the guide RNA comprising a targeting sequence.

In some embodiments, wherein the gNA is a gRNA, the term "targeter" or "targeter RNA" is used herein to refer to a crRNA-like molecule (crRNA: "CRISPR RNA") of a CasX dual guide RNA (dgRNA). In a single guide RNA (sgRNA), the "activator" and the "targeter" are linked together, e.g., by intervening nucleotides). Thus, for example, a guide RNA (dgRNA or sgRNA) comprises a guide sequence and a duplex-forming segment of a crRNA, which can also be referred to as a crRNA repeat. Because the targeter sequence of a guide sequence hybridizes with a specific target nucleic acid sequence, a targeter can be modified by a user to hybridize with a desired target nucleic acid sequence. In some embodiments, the sequence of a targeter may often be a non-naturally occurring sequence. The targeter and the activator each have a duplex-forming segment, where the duplex forming segment of the targeter and the duplex-forming segment of the activator have complementarity with one another and hybridize to one another to form a double stranded duplex (dsRNA duplex for a gRNA). In some embodiments, a targeter comprises both the guide sequence of the CasX guide RNA and a stretch of nucleotides that forms one half of the dsRNA duplex of the protein-binding segment of the gNA. A corresponding tracrRNA-like molecule (the activator "trans-acting CRISPR RNA") also comprises a duplex-forming stretch of nucleotides that forms the other half of the dsRNA duplex of the protein-binding segment of the CasX guide RNA. In some cases the activator comprises one or more stem loops that can interact with CasX protein. Thus, a targeter and an activator, as a corresponding pair, hybridize to form a CasX dual guide NA, referred to herein as a "dual guide NA", a "dgNA", a "double-molecule guide NA", or a "two-molecule guide NA".

In some embodiments, the activator and targeter of the reference gNA are covalently linked to one another and comprise a single molecule, referred to herein as a "single-molecule guide NA," "one-molecule guide NA," "single guide NA", "single guide RNA", a "single-molecule guide RNA," a "one-molecule guide RNA", a "single guide DNA", a "single-molecule DNA", or a "one-molecule guide DNA", ("sgNA", "sgRNA", or a "sgDNA"). In some embodiments, the sgNA includes an "activator" or a "targeter" and thus can be an "activator-RNA" and a "targeter-RNA," respectively.

The reference gRNAs of the disclosure comprise four distinct regions, or domains: the RNA triplex, the scaffold stem, the extended stem, and the targeting sequence (specific for a target nucleic acid. The RNA triplex, the scaffold stem, and the extended stem, together, are referred to as the "scaffold" of the reference gNA, based upon which further gNA variants are generated.

b. RNA Triplex

In some embodiments of the guide NAs provided herein, the gNA comprises an RNA triplex, and the RNA triplex comprises the sequence of a UUU--$N_X$(~4-15)--UUU stem loop (SEQ ID NO: 241) that ends with an AAAG after 2 intervening stem loops (the scaffold stem loop and the extended stem loop), forming a pseudoknot that may also extend past the triplex into a duplex pseudoknot. The UU-UUU-AAA sequence of the triplex forms as a nexus between the targeting sequence, scaffold stem, and extended stem. In exemplary gRNAs, the UUU-loop-UUU region is coded for first, then the scaffold stem loop, and then the extended stem loop, which is linked by the tetraloop, and then an AAAG closes off the triplex before becoming the targeting sequence.

c. Scaffold Stem Loop

In some embodiments of gNAs of the disclosure, the triplex region is followed by the scaffold stem loop. The scaffold stem loop is a region of the gNA that is bound by CasX protein (such as a reference or CasX variant protein). In some embodiments, the scaffold stem loop is a fairly short and stable stem loop, and increases the overall stability of the gNA. In some cases, the scaffold stem loop does not tolerate many changes, and requires some form of an RNA bubble. In some embodiments, the scaffold stem is necessary for gNA function. While it is perhaps analogous to the nexus stem of Cas9 as being a critical stem loop, the scaffold stem of a gNA, in some embodiments, has a necessary bulge (RNA bubble) that is different from many other stem loops found in CRISPR/Cas systems. In some embodiments, the presence of this bulge is conserved across gNA that interact with different CasX proteins. An exemplary sequence of a scaffold stem loop sequence of a gNA comprises the sequence CCAGCGACUAUGUCGUAUGG (SEQ ID NO:

242). In other embodiments, the disclosure provides gNA variants wherein the scaffold stem loop is replaced with an RNA stem loop sequence from a heterologous RNA source with proximal 5' and 3' ends, such as, but not limited to stem loop sequences selected from MS2, Qβ, U1 hairpin II, Uvsx, or PP7 stem loops. In some cases, the heterologous RNA stem loop of the gNA is capable of binding a protein, an RNA structure, a DNA sequence, or a small molecule.

d. Extended Stem Loop

In some embodiments of the gNAs of the disclosure, the scaffold stem loop is followed by the extended stem loop. In some embodiments, the extended stem comprises a synthetic tracr and crRNA fusion that is largely unbound by the CasX protein. In some embodiments, the extended stem loop can be highly malleable. In some embodiments, a single guide gRNA is made with a GAAA tetraloop linker or a GAGAAA linker between the tracr and crRNA in the extended stem loop. In some cases, the targeter and activator of a sgNA are linked to one another by intervening nucleotides and the linker can have a length of from 3 to 20 nucleotides. In some embodiments of the sgNAs of the disclosure, the extended stem is a large 32-bp loop that sits outside of the CasX protein in the ribonucleoprotein complex. An exemplary sequence of an extended stem loop sequence of a sgNA comprises the sequence GCGCUUAUUUAUCG-GAGAGAAAUCCGAUAAAUAAGAAGC (SEQ ID NO: 15). In some embodiments, the extended stem loop comprises a GAGAAA spacing sequence. In some embodiments, the disclosure provides gNA variants wherein the extended stem loop is replaced with an RNA stem loop sequence from a heterologous RNA source with proximal 5' and 3' ends, such as, but not limited to stem loop sequences selected from MS2, Qβ, U1 hairpin II, Uvsx, or PP7 stem loops. In such cases, the heterologous RNA stem loop increases the stability of the gNA. In other embodiments, the disclosure provides gNA variants having an extended stem loop region comprising at least 10, at least 100, at least 500, at least 1000, or at least 10,000 nucleotides.

e. Targeting Sequence

In some embodiments of the gNAs of the disclosure, the extended stem loop is followed by a region that forms part of the triplex, and then the targeting sequence (or "spacer"). The targeting sequence can be designed to target the CasX ribonucleoprotein holo complex to a specific region of the target nucleic acid sequence. Thus, the gNA targeting sequences of the gNAs of the disclosure have sequences complementarity to, and therefore can hybridize to, a portion of the target nucleic acid in a nucleic acid in a eukaryotic cell, (e.g., a eukaryotic chromosome, chromosomal sequence, a eukaryotic RNA, etc.) as a component of the RNP when any one of the PAM sequences TTC, ATC, GTC, or CTC is located 1 nucleotide 5' to the non-target strand sequence complementary to the target sequence.

In some embodiments, the disclosure provides a gNA wherein the targeting sequence of the gNA is complementary to a target nucleic acid sequence comprising one or more mutations compared to a wild-type gene sequence for purposes of editing the sequence comprising the mutations with the CasX:gNA systems of the disclosure. In some embodiments, the targeting sequence of a gNA is designed to be specific for an exon of the gene of the target nucleic acid. In other embodiments, the targeting sequence of a gNA is designed to be specific for an intron of the gene of the target nucleic acid. In other embodiments, the targeting sequence of the gNA is designed to be specific for an intron-exon junction of the gene of the target nucleic acid. In other embodiments, the targeting sequence of the gNA is designed to be specific for a regulatory element of the gene of the target nucleic acid. In some embodiments, the targeting sequence of the gNA is designed to be complementary to a sequence comprising one or more single nucleotide polymorphisms (SNPs) in a gene of the target nucleic acid. SNPs that are within the coding sequence or within non-coding sequences are both within the scope of the instant disclosure. In other embodiments, the targeting sequence of the gNA is designed to be complementary to a sequence of an intergenic region of the gene of the target nucleic acid.

In some embodiments, the targeting sequence of a gNA is designed to be specific for a regulatory element that regulates expression of the gene product of the target nucleic acid. Such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the gene of the target nucleic acid. In some embodiments of the foregoing, the targets are those in which the encoding gene of the target is intended to be knocked out or knocked down such that the encoded protein comprising mutations is not expressed or is expressed at a lower level in a cell.

In some embodiments, the targeting sequence of a gNA has between 14 and 35 consecutive nucleotides. In some embodiments, the targeting sequence has 14, 15, 16, 17, 18, 19, 20, 21, 22, 23, 24, 25, 26, 27, 28, 29, 30, 31, 32, 33, 34 or 35 consecutive nucleotides. In some embodiments, the targeting sequence of the gNA consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. In some embodiments, the targeting sequence has 14, 15, 16, 17, 18, 19, 20, 21, 22, 23, 24, 25, 26, 27, 28, 29, 30, 31, 32, 33, 34 or 35 consecutive nucleotides and the targeting sequence can comprise 0 to 5, 0 to 4, 0 to 3, or 0 to 2 mismatches relative to the target nucleic acid sequence and retain sufficient binding specificity such that the RNP comprising the gNA comprising the targeting sequence can form a complementary bond with respect to the target nucleic acid.

In some embodiments, the CasX:gNA system comprises a first gNA and further comprises a second (and optionally a third, fourth, fifth, or more) gNA, wherein the second gNA or additional gNA has a targeting sequence complementary to a different or overlapping portion of the target nucleic acid sequence compared to the targeting sequence of the first gNA such that multiple points in the target nucleic acid are targeted, and for example, multiple breaks are introduced in the target nucleic acid by the CasX. It will be understood that in such cases, the second or additional gNA is complexed with an additional copy of the CasX protein. By selection of the targeting sequences of the gNA, defined regions of the target nucleic acid sequence bracketing a mutation can be modified or edited using the CasX:gNA systems described herein, including facilitating the insertion of a donor template.

f. gNA Scaffolds

With the exception of the targeting sequence region, the remaining regions of the gNA are referred to herein as the scaffold. In some embodiments, the gNA scaffolds are derived from naturally-occurring sequences, described below as reference gNA. In other embodiments, the gNA scaffolds are variants of reference gNA wherein mutations, insertions, deletions or domain substitutions are introduced to confer desirable properties on the gNA.

In some embodiments, a reference gRNA comprises a sequence isolated or derived from Deltaproteobacteria. In some embodiments, the sequence is a CasX tracrRNA sequence. Exemplary CasX reference tracrRNA sequences isolated or derived from Deltaproteobacteria may include: ACAUCUGGCGCGUUUAUUCCAUUACUUUGGAG-CCAGUCCCAGCGACUAUGUCG UAUGGACGAAG-CGCUUAUUUAUCGGAGA (SEQ ID NO: 6) and ACAUCUGGCGCGUUUAUUCCAUUACUUUGGAG-CCAGUCCCAGCGACUAUGUCG UAUGGACGAA-GCGCUUAUUUAUCGG (SEQ ID NO: 7). Exemplary crRNA sequences isolated or derived from Deltaproteobacteria may comprise a sequence of CCGAUA-AGUAAAACGCAUCAAAG (SEQ ID NO: 243). In some embodiments, a reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Deltaproteobacteria.

In some embodiments, a reference guide RNA comprises a sequence isolated or derived from Planctomycetes. In some embodiments, the sequence is a CasX tracrRNA sequence. Exemplary reference tracrRNA sequences isolated or derived from Planctomycetes may include: UACUGGCGCUUUUAUCUCAUUACUUUGAGAGC-CAUCACCAGCGACUAUGUCGU AUGGGUAAA-GCGCUUAUUUAUCGGAGA (SEQ ID NO: 8) and UACUGGCGCUUUUAUCUCAUUACUUUGAGAGC-CAUCACCAGCGACUAUGUCGU AUGGGUAAA-GCGCUUAUUUAUCGG (SEQ ID NO: 9). Exemplary crRNA sequences isolated or derived from Planctomycetes may comprise a sequence of UCUCCGAUAAAUAA-GAAGCAUCAAAG (SEQ ID NO: 244). In some embodiments, a reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Planctomycetes.

In some embodiments, a reference gNA comprises a sequence isolated or derived from *Candidatus* Sungbacteria. In some embodiments, the sequence is a CasX tracrRNA sequence. Exemplary CasX reference tracrRNA sequences isolated or derived from *Candidatus* Sungbacteria may comprise sequences of: GUUUACACACUCCCUCU-CAUAGGGU (SEQ ID NO: 10), GUUUACACACUCC-CUCUCAUGAGGU (SEQ ID NO: 11), UUUUA-CAUACCCCUCUCAUGGGAU (SEQ ID NO: 12) and GUUUACACACUCCCUCUCAUGGGGG (SEQ ID NO: 13). In some embodiments, a reference guide RNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from *Candidatus* Sungbacteria.

Table 1 provides the sequences of reference gRNA tracr, cr and scaffold sequences. In some embodiments, the disclosure provides gNA sequences wherein the gNA has a scaffold comprising a sequence having at least one nucleotide modification relative to a reference gNA sequence having a sequence of any one of SEQ ID NOS: 4-16 of Table 1. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 1

Reference gRNA tracr, cr and scaffold sequences

| SEQ ID NO. | Nucleotide Sequence |
|---|---|
| 4 | ACAUCUGGCGCGUUUAUUCCAUUACUUUGGAGCCAGUCCCAGCGA CUAUGUCGUAUGGACGAAGCGCUUAUUUAUCGGAGAGAAACCGAU AAGUAAAACGCAUCAAAG |
| 5 | UACUGGCGCUUUUAUCUCAUUACUUUGAGAGCCAUCACCAGCGAC UAUGUCGUAUGGGUAAAGCGCUUAUUUAUCGGAGAGAAAUCCGAU AAAUAAGAAGCAUCAAAG |
| 6 | ACAUCUGGCGCGUUUAUUCCAUUACUUUGGAGCCAGUCCCAGCGA CUAUGUCGUAUGGACGAAGCGCUUAUUUAUCGGAGA |
| 7 | ACAUCUGGCGCGUUUAUUCCAUUACUUUGGAGCCAGUCCCAGCGA CUAUGUCGUAUGGACGAAGCGCUUAUUUAUCGG |
| 8 | UACUGGCGCUUUUAUCUCAUUACUUUGAGAGCCAUCACCAGCGAC UAUGUCGUAUGGGUAAAGCGCUUAUUUAUCGGAGA |
| 9 | UACUGGCGCUUUUAUCUCAUUACUUUGAGAGCCAUCACCAGCGAC UAUGUCGUAUGGGUAAAGCGCUUAUUUAUCGG |
| 10 | GUUUACACACUCCCUCUCAUAGGGU |
| 11 | GUUUACACACUCCCUCUCAUGAGGU |
| 12 | UUUUACAUACCCCUCUCAUGGGAU |
| 13 | GUUUACACACUCCCUCUCAUGGGGG |
| 14 | CCAGCGACUAUGUCGUAUGG |

TABLE 1-continued

Reference gRNA tracr, cr and scaffold sequences

| SEQ ID NO. | Nucleotide Sequence |
|---|---|
| 15 | GCGCUUAUUUAUCGGAGAGAAAUCCGAUAAAUAAGAAGC |
| 16 | GGCGCUUUUAUCUCAUACUUUGAGAGCCAUCACCAGCGACUAUGU CGUAUGGGUAAAGCGCUUAUUUAUCGGA | g. gNA Variants

In another aspect, the disclosure relates to guide nucleic acid variants (referred to herein alternatively as "gNA variant" or "gRNA variant"), which comprise one or more modifications relative to a reference gRNA scaffold. As used herein, "scaffold" refers to all parts to the gNA necessary for gNA function with the exception of the spacer sequence.

In some embodiments, a gNA variant comprises one or more nucleotide substitutions, insertions, deletions, or swapped or replaced regions relative to a reference gRNA sequence of the disclosure. In some embodiments, a mutation can occur in any region of a reference gRNA scaffold to produce a gNA variant. In some embodiments, the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4 or SEQ ID NO: 5.

In some embodiments, a gNA variant comprises one or more nucleotide changes within one or more regions of the reference gRNA scaffold that improve a characteristic of the reference gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In some embodiments, the gNA variant scaffold comprises a scaffold stem loop having at least 60% sequence identity, at least 70% sequence identity, at least 80% sequence identity, at least 90% sequence identity, at least 95% sequence identity, or at least 99% sequence identity to SEQ ID NO: 14. In some embodiments, the gNA variant scaffold comprises a scaffold stem loop having at least 60% sequence identity to SEQ ID NO: 14. In other embodiments, the gNA variant comprises a scaffold stem loop having the sequence of CCAGCGACUAUGU-CGUAGUGG (SEQ ID NO: 245). In other embodiments, the disclosure provides a gNA scaffold comprising, relative to SEQ ID NO:5, a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem was converted to a fully base-paired stem contiguous with the new Uvsx hairpin by deletion of the A99 and substitution of G65U. In the foregoing embodiment, the gNA scaffold comprises the sequence ACUGGCGCUUUUAUCUGAUUACUUUGA-GAGCCAUCACCAGCGACUAUGUCGUAGUGG-GUAAAGCUCCCUCUUCGG AGGGAGCAUCAAAG (SEQ ID NO: 2238).

All gNA variants that have one or more improved characteristics, or add one or more new functions when the variant gNA is compared to a reference gRNA described herein, are envisaged as within the scope of the disclosure. A representative example of such a gNA variant is guide 174 (SEQ ID NO: 2238), the design of which is described in the Examples. In some embodiments, the gNA variant adds a new function to the RNP comprising the gNA variant. In some embodiments, the gNA variant has an improved characteristic selected from: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target DNA when complexed with a CasX protein; improved gene editing when complexed with a CasX protein; improved specificity of editing when complexed with a CasX protein; and improved ability to utilize a greater spectrum of one or more PAM sequences, including ATC, CTC, GTC, or TTC, in the editing of target DNA when complexed with a CasX protein, and any combination thereof. In some cases, the one or more of the improved characteristics of the gNA variant is at least about 1.1 to about 100,000-fold improved relative to the reference gNA of SEQ ID NO: 4 or SEQ ID NO: 5. In other cases, the one or more improved characteristics of the gNA variant is at least about 1.1, at least about 10, at least about 100, at least about 1000, at least about 10,000, at least about 100,000-fold or more improved relative to the reference gNA of SEQ ID NO: 4 or SEQ ID NO: 5. In other cases, the one or more of the improved characteristics of the gNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference gNA of SEQ ID NO: 4 or SEQ ID NO: 5. In other cases, the one or more improved characteristics of the gNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to the reference gNA of SEQ ID NO: 4 or SEQ ID NO: 5.

In some embodiments, a gNA variant can be created by subjecting a reference gNA to a one or more mutagenesis methods, such as the mutagenesis methods described herein, below, which may include Deep Mutational Evolution (DME), deep mutational scanning (DMS), error prone PCR, cassette mutagenesis, random mutagenesis, staggered extension PCR, gene shuffling, or domain swapping, in order to generate the gNA variants of the disclosure. The activity of reference gNAs may be used as a benchmark against which the activity of gNA variants are compared, thereby measuring improvements in function of gNA variants. In other embodiments, a reference gNA may be subjected to one or more deliberate, targeted mutations, substitutions, or domain swaps in order to produce a gNA variant, for example a rationally designed variant. Exemplary gNA variants produced by such methods are described in the Examples and representative sequences of gNA scaffolds are presented in Table 2.

In some embodiments, the gNA variant comprises one or more modifications compared to a reference guide nucleic acid scaffold sequence, wherein the one or more modification is selected from: at least one nucleotide substitution in a region of the reference gNA at least one nucleotide deletion in a region of the reference gNA; at least one nucleotide insertion in a region of the reference gNA; a substitution of all or a portion of a region of the reference gNA; a deletion of all or a portion of a region of the reference gNA; or any combination of the foregoing. In some cases, the modification is a substitution of 1 to 15 consecutive or non-consecutive nucleotides in the reference gNA in one or more regions. In other cases, the modification is a deletion of 1 to 10 consecutive or non-consecutive nucleotides in the reference gNA in one or more regions. In other cases, the modification is an insertion of 1 to 10 consecutive or non-consecutive nucleotides in the reference gNA in one or more regions. In other cases, the modification is a substitution of the scaffold stem loop or the extended stem loop with an RNA stem loop sequence from a heterologous RNA source with proximal 5' and 3' ends. In some cases, a gNA variant of the disclosure comprises two or more modifications in one region relative to a reference gRNA. In other cases, a gNA variant of the disclosure comprises modifications in two or more regions. In other cases, a gNA variant comprises any combination of the foregoing modifications described in this paragraph. In some embodiments, exemplary modifications of gNA of the disclosure include the modifications of Table 24.

In some embodiments, a 5' G is added to a gNA variant sequence, relative to a reference gRNA, for expression in vivo, as transcription from a U6 promoter is more efficient and more consistent with regard to the start site when the +1 nucleotide is a G. In other embodiments, two 5' Gs are added to generate a gNA variant sequence for in vitro transcription to increase production efficiency, as T7 polymerase strongly prefers a G in the +1 position and a purine in the +2 position. In some cases, the 5' G bases are added to the reference scaffolds of Table 1. In other cases, the 5' G bases are added to the variant scaffolds of Table 2.

Table 2 provides exemplary gNA variant scaffold sequences of the disclosure. In Table 2, (–) indicates a deletion at the specified position(s) relative to the reference sequence of SEQ ID NO: 5, (+) indicates an insertion of the specified base(s) at the position indicated relative to SEQ ID NO: 5, (:) indicates the range of bases at the specified start:stop coordinates of a deletion or substitution relative to SEQ ID NO: 5, and multiple insertions, deletions or substitutions are separated by commas; e.g., A14C, T17G. In some embodiments, the gNA variant scaffold comprises any one of the sequences listed in Table 2, SEQ ID NOS: 2101-2280, or a sequence having at least about 50, at least about 60, at least about 70%, at least about 80%, at least about 90%, at least about 95%, at least about 95%, at least about 96%, at least about 97%, at least about 98%, at least about 99% sequence identity thereto. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 2

Exemplary gNA Variant Scaffold Sequences

| SEQ ID NO: | NAME or Modification | NUCLEOTIDE SEQUENCE |
|---|---|---|
| 2101 | phage replication stable | UACUGGCGCUUUUAUCUCAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2102 | Kissing loop_b1 | UACUGGCGCUUUUAUCUCAUUACUUUGAGAGCCAUCACCAGCGACUAUGUCGUAUG GGUAAAGCGCUGCUCGACGCGUCCUCGAGCAGAAGCAUCAAAG |
| 2103 | Kissing loop_a | UACUGGCGCUUUUAUCUCAUUACUUUGAGAGCCAUCACCAGCGACUAUGUCGUAUG GGUAAAGCGCUGCUCGCUCCGUUCGAGCAGAAGCAUCAAAG |
| 2104 | 32, uvsX hairpin | GUACUGGCGCUUUUAUCUCAUUACUUUGAGAGCCAUCACCAGCGACUAUGUCGUAU GGGUAAAGCGCCCUCUUCGGAGGGAAGCAUCAAAG |
| 2105 | PP7 | UACUGGCGCUUUUAUCUCAUUACUUUGAGAGCCAUCACCAGCGACUAUGUCGUAUG GGUAAAGCGCAGGAGUUUCUAUGGAAACCCUGAAGCAUCAAAG |
| 2106 | 64, trip mut, extended stem truncation | GUACUGGCGCCUUUUAUCUCAUUACUUUGAGAGCCAUCACCAGCGACUAUGUCGUAU GGGUAAAGCGCUUACGGACUUCGGUCCGUAAGAAGCAUCAAAG |
| 2107 | hyperstable tetraloop | UACUGGCGCUUUUAUCUCAUUACUUUGAGAGCCAUCACCAGCGACUAUGUCGUAUG GGUAAAGCGCUGCGCUUGCGCAGAAGCAUCAAAG |
| 2108 | C18G | UACUGGCGCUUUUAUCUGAUUACUUUGAGAGCCAUCACCAGCGACUAUGUCGUAUG GGUAAAGCGCUUAUUUAUCGGAGAGAAAUCCGAUAAAUAAGAAGCAUCAAAG |

TABLE 2-continued

Exemplary gNA Variant Scaffold Sequences

| SEQ ID NO: | NAME or Modification | NUCLEOTIDE SEQUENCE |
|---|---|---|
| 2109 | T17G | UACUGGCGCUUUUAUCGCAUUACUUUGAGAGCCAUCACCAGCGACUAUGUCGUAUG GGUAAAGCGCUUAUUUAUCGGAGAGAAAUCCGAUAAAUAAGAAGCAUCAAAG |
| 2110 | CUUCGG loop | UACUGGCGCUUUUAUCUCAUUACUUUGAGAGCCAUCACCAGCGACUAUGUCGUAUG GGUAAAGCGCUUAUUUAUCGGAGACUUCGGUCCGAUAAAUAAGAAGCAUCAAAG |
| 2111 | MS2 | UACUGGCGCUUUUAUCUCAUUACUUUGAGAGCCAUCACCAGCGACUAUGUCGUAUG GGUAAAGCGCACAUGAGGAUUACCCAUGUGAAGCAUCAAAG |
| 2112 | -1, A2G, -78, G77T | GCUGGCGCUUUUAUCUCAUUACUUUGAGAGCCAUCACCAGCGACUAUGUCGUAUGG GUAAAGCGCUUAUUUAUCGUGAGAAAUCCGAUAAAUAAGAAGCAUCAAAG |
| 2113 | QB | UACUGGCGCUUUUAUCUCAUUACUUUGAGAGCCAUCACCAGCGACUAUGUCGUAUG GGUAAAGCGCUGCAUGUCUAAGACAGCAGAAGCAUCAAAG |
| 2114 | 45, 44 hairpin | UACUGGCGCUUUUAUCUCAUUACUUUGAGAGCCAUCACCAGCGACUAUGUCGUAUG GGUAAAGCGCAGGGCUUCGGCCGAAGCAUCAAAG |
| 2115 | U1A | UACUGGCGCUUUUAUCUCAUUACUUUGAGAGCCAUCACCAGCGACUAUGUCGUAUG GGUAAAGCGCAAUCCAUUGCACUCCGGAUUGAAGCAUCAAAG |
| 2116 | A14C, T17G | UACUGGCGCUUUUCUCGCAUUACUUUGAGAGCCAUCACCAGCGACUAUGUCGUAUG GGUAAAGCGCUUAUUUAUCGGAGAGAAAUCCGAUAAAUAAGAAGCAUCAAAG |
| 2117 | CUUCGG loop modified | UACUGGCGCUUUUAUCUCAUUACUUUGAGAGCCAUCACCAGCGACUAUGUCGUAUG GGUAAAGCGCUUAUUUAUCGGACUUCGGUCCGAUAAAUAAGAAGCAUCAAAG |
| 2118 | Kissing loop_b2 | UACUGGCGCUUUUAUCUCAUUACUUUGAGAGCCAUCACCAGCGACUAUGUCGUAUG GGUAAAGCGCUGCUCGUUUGCGGCUACGAGCAGAAGCAUCAAAG |
| 2119 | -76:78, -83:87 | UACUGGCGCUUUUAUCUCAUUACUUUGAGAGCCAUCACCAGCGACUAUGUCGUAUG GGUAAAGCGCUUAUUUAUCGAGAGAUAAAUAAGAAGCAUCAAAG |
| 2120 | -4 | UACGGCGCUUUUAUCUCAUUACUUUGAGAGCCAUCACCAGCGACUAUGUCGUAUGG GUAAAGCGCUUAUUUAUCGGAGAGAAAUCCGAUAAAUAAGAAGCAUCAAAG |
| 2121 | extended stem truncation | UACUGGCGCCUUUUAUCUCAUUACUUUGAGAGCCAUCACCAGCGACUAUGUCGUAU GGGUAAAGCGCUUACGGACUUCGGUCCGUAAGAAGCAUCAAAG |
| 2122 | C55 | UACUGGCGCUUUUAUCUCAUUACUUUGAGAGCCAUCACCAGCGACUAUGUCGUAUC GGUAAAGCGCUUAUUUAUCGGAGAGAAAUCCGAUAAAUAAGAAGCAUCAAAG |
| 2123 | trip mut | UACUGGCGCCUUUUAUCUCAUUACUUUGAGAGCCAUCACCAGCGACUAUGUCGUAUC GGUAAAGCGCUUAUUUAUCGGACUUCGGUCCGAUAAAUAAGAAGCAUCAAAG |
| 2124 | -76:78 | UACUGGCGCCUUUAUCUCAUUACUUUGAGAGCCAUCACCAGCGACUAUGUCGUAUC GGUAAAGCGCUUAUUUAUCGAGAAAUCCGAUAAAUAAGAAGCAUCAAAG |
| 2125 | -1:5 | GCGCUUUUAUCUCAUUACUUUGAGAGCCAUCACCAGCGACUAUGUCGUAUGGGUAA AGCGCUUAUUUAUCGGAGAGAAAUCCGAUAAAUAAGAAGCAUCAAAG |
| 2126 | -83:87 | UACUGGCGCUUUUAUCUCAUUACUUUGAGAGCCAUCACCAGCGACUAUGUCGUAUG GGUAAAGCGCUUAUUUAUCGGAGAGAUAAAUAAGAAGCAUCAAAG |
| 2127 | =+G28, A82T, -84. | UACUGGCGCUUUUAUCUCAUUACUUUGAGAGCCAUCACCAGCGACUAUGUCGUAU GGGUAAAGCGCUUAUUUAUCGGAGAGUAUCCGAUAAAUAAGAAGCAUCAAAG |
| 2128 | =+51T | UACUGGCGCUUUUAUCUCAUUACUUUGAGAGCCAUCACCAGCGACUAUGUUCGUAU GGGUAAAGCGCUUAUUUAUCGGAGAGAAAUCCGAUAAAUAAGAAGCAUCAAAG |
| 2129 | -1:4, +G5A, +G86, | AGCGCUUUUAUCUCAUUACUUUGAGAGCCAUCACCAGCGACUAUGUCGUAUGGGUA AAGCGCUUAUUUAUCGGAGAGAAAUGCCGAUAAAUAAGAAGCAUCAAAG |
| 2130 | =+A94 | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAG |
| 2131 | =+G72 | UACUGGCGCUUUUAUCUCAUUACUUUGAGAGCCAUCACCAGCGACUAUGUCGUAUG GGUAAAGCGCUUAUUGUAUCGGAGAGAAAUCCGAUAAAUAAGAAGCAUCAAAG |
| 2132 | shorten front, CUUCGG loop modified, extend extended | GCGCUUUAUCUCAUUACUUUGAGAGCCAUCACCAGCGACUAUGUCGUAUGGGUAA AGCGCUUAUUUAUCGGACUUCGGUCCGAUAAAUAAGCGCAUCAAAG |

TABLE 2-continued

Exemplary gNA Variant Scaffold Sequences

| SEQ ID NO: | NAME or Modification | NUCLEOTIDE SEQUENCE |
| --- | --- | --- |
| 2133 | A14C | UACUGGCGCUUUUCUCUCAUUACUUUGAGAGCCAUCACCAGCGACUAUGUCGUAUG GGUAAAGCGCUUAUUUAUCGGAGAGAAAUCCGAUUAAUAAGAAGCAUCAAAG |
| 2134 | -1:3, +G3 | GUGGCGCUUUUAUCUCAUUACUUUGAGAGCCAUCACCAGCGACUAUGUCGUAUGGG UAAAGCGCUUAUUUAUCGGAGAGAAAUCCGAUAAAUAAGAAGCAUCAAAG |
| 2135 | =+C45, +T46 | UACUGGCGCUUUUAUCUCAUUACUUUGAGAGCCAUCACCAGCGACCUUAUGUCGUA UGGGUAAAGCGCUUAUUUAUCGGAGAGAAAUCCGAUAAAUAAGAAGCAUCAAAG |
| 2136 | CUUCGG loop modified, fun start | GAUGGCGCUUUUAUCUCAUUACUUUGAGAGCCAUCACCAGCGACUAUGUCGUAUGG GUAAAGCGCUUAUUUAUCGGACUUCGGUCCGAUAAAUAAGAAGCAUCAAAG |
| 2137 | -93:94 | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAAGAAGCAUCAAAG |
| 2138 | =+T45 | UACUGGCGCUUUUAUCUCAUUACUUUGAGAGCCAUCACCAGCGAUCUAUGUCGUAU GGGUAAAGCGCUUAUUUAUCGGAGAGAAAUCCGAUAAAUAAGAAGCAUCAAAG |
| 2139 | -69, -94 | UACUGGCGCUUUUAUCUCAUUACUUUGAGAGCCAUCACCAGCGACUAUGUCGUAUG GGUAAAGGCUUAUUUAUCGGAGAGAAAUCCGAUAAAAGAAGCAUCAAAG |
| 2140 | -94 | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAAAGAAGCAUCAAAG |
| 2141 | modified CUUCGG, minus T in 1st triplex | UACUGGCGCUUUAUCUCAUUACUUUGAGAGCCAUCACCAGCGACUAUGUCGUAUGG GUAAAGCGCUUAUUUAUCGGACUUCGGUCCGAUAAAUAAGAAGCAUCAAAG |
| 2142 | -1:4, +C4, A14C, T17G, +G72, -76:78, -83:87 | CGGCGCUUUUCUCGCAUUACUUUGAGAGCCAUCACCAGCGACUAUGUCGUAUGGGU AAAGCGCUUAUUGUAUCGAGAGAUAAAUAAGAAGCAUCAAAG |
| 2143 | T1C, -73 | CACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAG |
| 2144 | Scaffold uuCG, stem uuCG. Stem swap, t shorten | UACUGGCGCUUUAUCUCAUUACUUUGAGAGCCAUCACCAGCGACUUCGGUCGUAUG GGUAAAGCGCUUAUGUAUCGGCUUCGGCCGAUACAUAAGAAGCAUCAAAG |
| 2145 | Scaffold uuCG, stem uuCG. Stem swap | UACUGGCGCUUUUAUCUCAUUACUUUGAGAGCCAUCACCAGCGACUUCGGUCGUAU GGGUAAAGCGCUUAUGUAUCGGCUUCGGCCGAUACAUAAGAAGCAUCAAAG |
| 2146 | =+G60 | UACUGGCGCUUUUAUCUCAUUACUUUGAGAGCCAUCACCAGCGACUAUGUCGUAUG GGUGAAAGCGCUAUUUAUCGGAGAGAAAUCCGAUAAAUAAGAAGCAUCAAAG |
| 2147 | no stem Scaffold uuCG | UACUGGCGCUUUUAUCUCAUUACUUUGAGAGCCAUCACCAGCGACUUCGGUCGUAU GGGUAAAG |
| 2148 | no stem Scaffold uuCG, fun start | GAUGGGCUUUUAUCUCAUUACUUUGAGAGCCAUCACCAGCGACUUCGGUCGUAUGG GUAAAG |
| 2149 | Scaffold uuCG, stem uuCG, fun start | GAUGGGCUUUUAUCUCAUUACUUUGAGAGCCAUCACCAGCGACUUCGGUCGUAUGG GUAAAGCGCUUAUUUAUCGGCUUCGGCCGAUAAAUAAGAAGCAUCAAAG |
| 2150 | Pseudoknots | UACUGGCGCUUUUAUCUCAUUACUUUGAGAGCCAUCACCAGCGACUAUGUCGUAUG GGUAAAGCGCUACACUGGGAUCGCUGAAUUAGAGAUCGGCGUCCUUUCAUUCUAUA UACUUUGGAGUUUUAAAAUGUCUCUAAGUACAGAAGCAUCAAAG |
| 2151 | Scaffold uuCG, stem uuCG | GGCGCUUUUAUCUCAUUACUUUGAGAGCCAUCACCAGCGACUUCGGUCGUAUGGGU AAAGCGCUUAUUUAUCGGCUUCGGCCGAUAAAUAAGAAGCAUCAAAG |
| 2152 | Scaffold uuCG, stem uuCG, no start | GCUGGCGCUUUUAUCUCAUUACUUUGAGAGCCAUCACCAGCGACUUCGGUCGUAUG GGUAAAGCGCUUAUUUAUCGGCUUCGGCCGAUAAAUAAGAAGCAUCAAAG |
| 2153 | Scaffold uuCG | UACUGGCGCUUUUAUCUCAUUACUUUGAGAGCCAUCACCAGCGACUUCGGUCGUAU GGGUAAAGCGCUUAUUUAUCGGAGAGAAAUCCGAUAAAUAAGAAGCAUCAAAG |

TABLE 2-continued

Exemplary gNA Variant Scaffold Sequences

| SEQ ID NO: | NAME or Modification | NUCLEOTIDE SEQUENCE |
|---|---|---|
| 2154 | =+GCTC36 | UACUGGCGCUUUUAUCUCAUUACUUUGAGAGCCAUGCUCCACCAGCGACUAUGUCG UAUGGGUAAAGCGCUUAUUUAUCGGAGAGAAAUCCGAUAAAUAAGAAGCAUCAAAG |
| 2155 | G quadriplex telomere basket + ends | UACUGGCGCUUUUAUCUCAUUACUUUGAGAGCCAUCACCAGCGACUAUGUCGUAUG GGUAAAGCGGGGUUAGGGUUAGGGUUAGGGAAGCAUCAAAG |
| 2156 | G quadriplex M3q | UACUGGCGCUUUUAUCUCAUUACUUUGAGAGCCAUCACCAGCGACUAUGUCGUAUG GGUAAAGCGGAGGGAGGGAGGGAGAGGGAAAGCAUCAAAG |
| 2157 | G quadriplex telomere basket no ends | UACUGGCGCUUUUAUCUCAUUACUUUGAGAGCCAUCACCAGCGACUAUGUCGUAUG GGUAAAGCGUUGGGUUAGGGUUAGGGUUAGGGAAAAGCAUCAAAG |
| 2158 | 45, 44 hairpin (old version) | UACUGGCGCUUUUAUCUCAUUACUUUGAGAGCCAUCACCAGCGACUAUGUCGUAUG GGUAAAGCGC--------AGGGCUUCGGCCG---------GAAGCAUCAAAG |
| 2159 | Sarcin-ricin loop | UACUGGCGCUUUUAUCUCAUUACUUUGAGAGCCAUCACCAGCGACUAUGUCGUAUG GGUAAAGCGCCUGCUCAGUACGAGAGGAACCGCAGGAAGCAUCAAAG |
| 2160 | uvsX, C18G | UACUGGCGCUUUUAUCUGAUUACUUUGAGAGCCAUCACCAGCGACUAUGUCGUAUG GGUAAAGCGCCCUCUUCGGAGGGAAGCAUCAAAG |
| 2161 | truncated stem loop, C18G, trip mut (T10C) | UACUGGCGCCUUUAUCUGAUUACUUUGAGAGCCAUCACCAGCGACUAUGUCGUAUG GGUAAAGCGCUUACGGACUUCGGUCCGUAAGAAGCAUCAAAG |
| 2162 | short phage rep, C18G | UACUGGCGCCUUUAUCUGAUUACUUUGAGAGCCAUCACCAGCGACUAUGUCGUAUG GGUAAAGCGCGGACGACCUCUCGGUCGUCCGAAGCAUCAAAG |
| 2163 | phage rep loop, C18G | UACUGGCGCCUUUAUCUGAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2164 | =+G18, stacked onto 64 | UACUGGCGCCUUUAUCUGCAUUACUUUGAGAGCCAUCACCAGCGACUAUGUCGUAU GGGUAAAGCGCUUACGGACUUCGGUCCGUAAGAAGCAUCAAAG |
| 2165 | truncated stem loop, C18G, -1 A2G | GCUGGCGCUUUUAUCUGAUUACUUUGAGAGCCAUCACCAGCGACUAUGUCGUAUGG GUAAAGCGCUUACGGACUUCGGUCCGUAAGAAGCAUCAAAG |
| 2166 | phage rep loop, C18G, trip mut (T10C) | UACUGGCGCCUUUAUCUGAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2167 | short phage rep, C18G, trip mut (T10C) | UACUGGCGCCUUUAUCUGAUUACUUUGAGAGCCAUCACCAGCGACUAUGUCGUAUG GGUAAAGCGCGGACGACCUCUCGGUCGUCCGAAGCAUCAAAG |
| 2168 | uvsX, trip mut (T10C) | UACUGGCGCCUUUAUCUCAUUACUUUGAGAGCCAUCACCAGCGACUAUGUCGUAUG GGUAAAGCGCCCUCUUCGGAGGGAAGCAUCAAAG |
| 2169 | truncated stem loop | UACUGGCGCUUUUAUCUCAUUACUUUGAGAGCCAUCACCAGCGACUAUGUCGUAUG GGUAAAGCGCUUACGGACUUCGGUCCGUAAGAAGCAUCAAAG |
| 2170 | =+A17, stacked onto 64 | UACUGGCGCCUUUAUCAUCAUUACUUUGAGAGCCAUCACCAGCGACUAUGUCGUAU GGGUAAAGCGCUUACGGACUUCGGUCCGUAAGAAGCAUCAAAG |
| 2171 | 3' HDV genomic ribozyme | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGCC GGCAUGGUCCCAGCCUCCUCGCUGGCGCCGGCUGGGCAACAUUCCGAGGGGACCGU CCCCUCGGUAAUGGCGAAUGGGACCC |
| 2172 | hage rep loop, trip mut (T10C) | UACUGGCGCCUUUAUCUCAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2173 | -79:80 | UACUGGCGCCUUUAUCUCAUUACUUUGAGAGCCAUCACCAGCGACUAUGUCGUAUG GGUAAAGCGCUUAUUUAUCGGAGAAAUCCGAUAAAUAAGAAGCAUCAAAG |
| 2174 | short phage rep, trip mut (T10C) | UACUGGCGCCUUUAUCUCAUUACUUUGAGAGCCAUCACCAGCGACUAUGUCGUAUG GGUAAAGCGCGGACGACCUCUCGGUCGUCCGAAGCAUCAAAG |
| 2175 | extra truncated stem loop | UACUGGCGCUUUUAUCUCAUUACUUUGAGAGCCAUCACCAGCGACUAUGUCGUAUG GGUAAAGCGCCGGACUUCGGUCCGGAAGCAUCAAAG |

TABLE 2-continued

Exemplary gNA Variant Scaffold Sequences

| SEQ ID NO: | NAME or Modification | NUCLEOTIDE SEQUENCE |
|---|---|---|
| 2176 | T17G, C18G | UACUGGCGCUUUUAUCGGAUUACUUUGAGAGCCAUCACCAGCGACUAUGUCGUAUG GGUAAAGCGCUUAUUUAUCGGAGAGAAAUCCGAUAAAUAAGAAGCAUCAAAG |
| 2177 | short phage rep | UACUGGCGCUUUUAUCUCAUUACUUUGAGAGCCAUCACCAGCGACUAUGUCGUAUG GGUAAAGCGCGGACGACCUCUCGGUCGUCCGAAGCAUCAAAG |
| 2178 | uvsX, C18G, -1 A2G | GCUGGCGCUUUUAUCUGAUUACUUUGAGAGCCAUCACCAGCGACUAUGUCGUAUGG GUAAAGCGCCCUCUUCGGAGGGAAGCAUCAAAG |
| 2179 | uvsX, C18G, trip mut (T10C), -1 A2G, HDV -99 G65U | GCUGGCGCCUUUUAUCUGAUUACUUUGAGAGCCAUCACCAGCGACUAUGUCGUAUGG GUAAAGCUCCCUCUUCGGAGGGAGCAUCAAAG |
| 2180 | 3' HDV antigenomic ribozyme | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGGU CGGCAUGGCAUCUCCACCUCCUCGCGGUCCGACCUGGGCAUCCGAAGGAGGACGCA CGUCCACUCGGAUGGCUAAGGGAGAGCCA |
| 2181 | uvsX, C18G, trip mut (T10C), -1 A2G, HDV AA(98:99)C | GCUGGCGCCUUUUAUCUGAUUACUUUGAGAGCCAUCACCAGCGACUAUGUCGUAUGG GUAAAGCGCCCUCUUCGGAGGGCGCAUCAAAG |
| 2182 | 3' HDV ribozyme (Lior Nissim, Timothy Lu) | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGUUUU GGCCGGCAUGGUCCCAGCCUCCUCGCUGGCGCCGGCUGGGCAACAUGCUUCGGCAU GGCGAAUGGGACCCCGGG |
| 2183 | TAC(1:3)GA, stacked onto 64 | GAUGGCGCCUUUUAUCUCAUUACUUUGAGAGCCAUCACCAGCGACUAUGUCGUAUGG GUAAAGCGCUUACGGACUUCGGUCCGUAAGAAGCAUCAAAG |
| 2184 | uvsX, -1 A2G | GCUGGCGCUUUUAUCUCAUUACUUUGAGAGCCAUCACCAGCGACUAUGUCGUAUGG GUAAAGCGCCCUCUUCGGAGGGAAGCAUCAAAG |
| 2185 | truncated stem loop, C18G, trip mut (T10C), -1 A2G, HDV -99 G65U | GCUGGCGCCUUUUAUCUGAUUACUUUGAGAGCCAUCACCAGCGACUAUGUCGUAUGG GUAAAGCUCUUACGGACUUCGGUCCGUAAGAGCAUCAAAG |
| 2186 | short phage rep, C18G, trip mut (T10C), -1 A2G, HDV -99 G65U | GCUGGCGCCUUUUAUCUGAUUACUUUGAGAGCCAUCACCAGCGACUAUGUCGUAUGG GUAAAGCUCGGACGACCUCUCGGUCGUCCGAGCAUCAAAG |
| 2187 | 3' sTRSV WT viral Hammerhead ribozyme | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCCUG UCACCGGAUGUGCUUUCCGGUCUGAUGAGUCCGUGAGGACGAAACAGG |
| 2188 | short phage rep, C18G, -1 A2G | GCUGGCGCCUUUUAUCUGAUUACUUUGAGAGCCAUCACCAGCGACUAUGUCGUAUGG GUAAAGCGCGGACGACCUCUCGGUCGUCCGAAGCAUCAAAG |
| 2189 | short phage rep, C18G, trip mut (T10C), -1 A2G, 3' genomic HDV | GCUGGCGCCUUUUAUCUGAUUACUUUGAGAGCCAUCACCAGCGACUAUGUCGUAUGG GUAAAGCGCGGACGACCUCUCGGUCGUCCGAAGCAUCAAAG |
| 2190 | phage rep loop, C18G, trip mut (T10C), -1 A2G, HDV -99 G65U | GCUGGCGCCUUUUAUCUGAUUACUUUGAGAGCCAUCACCAGCGACUAUGUCGUAUGG GUAAAGCUCAGGUGGGACGACCUCUCGGUCGUCCUAUCUGAGCAUCAAAG |
| 2191 | 3' HDV ribozyme (Owen Ryan, Jamie Cate) | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGAUG GCCGGCAUGGUCCCAGCCUCCUCGCUGGCGCCGGCUGGGCAACACCUUCGGGUGGC GAAUGGGAC |
| 2192 | phage rep loop, C18G, -1 A2G | GCUGGCGCCUUUUAUCUGAUUACUUUGAGAGCCAUCACCAGCGACUAUGUCGUAUGG GUAAAGCGCAGGUGGGACGACCUCUCGGUCGUCCUAUCUGAAGCAUCAAAG |

TABLE 2-continued

Exemplary gNA Variant Scaffold Sequences

| SEQ ID NO: | NAME or Modification | NUCLEOTIDE SEQUENCE |
| --- | --- | --- |
| 2193 | 0.14 | UACUGGCGCUUUUAUCUCAUUACUUUGAGAGCCAUCACCAGCGACUAUGUCGUACUGGGUAAAGCGCUUAUUUAUCGGAGAGAAAUCCGAUAAAUAAGAAGCAUCAAAG |
| 2194 | -78, G77T | UACUGGCGCUUUUAUCUCAUUACUUUGAGAGCCAUCACCAGCGACUAUGUCGUAUGGGUAAAGCGCUUAUUUAUCGUGAGAAAUCCGAUAAAUAAGAAGCAUCAAAG |
| 2195 | | GUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2196 | short phage rep, -1 A2G | GCUGGCGCUUUUAUCUCAUUACUUUGAGAGCCAUCACCAGCGACUAUGUCGUAUGGGUAAAGCGCGGACGACCUCUCGGUCGUCCGAAGCAUCAAAG |
| 2197 | truncated stem loop, C18G, trip mut (T10C), -1 A2G | GCUGGCGCCUUUAUCUGAUUACUUUGAGAGCCAUCACCAGCGACUAUGUCGUAUGGGUAAAGCGCUUACGGACUUCGGUCCGUAAGAAGCAUCAAAG |
| 2198 | -1, A2G | GCUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2199 | truncated stem loop, trip mut (T10C), -1 A2G | GCUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2200 | uvsX, C18G, trip mut (T10C), -1 A2G | GCUGGCGCCUUUAUCUGAUUACUUUGAGAGCCAUCACCAGCGACUAUGUCGUAUGGGUAAAGCGCCCUCUUCGGAGGGAAGCAUCAAAG |
| 2201 | phage rep loop, -1 A2G | GCUGGCGCUUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2202 | phage rep loop, trip mut (T10C), -1 A2G | GCUGGCGCCUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2203 | phage rep loop, C18G, trip mut (T10C), -1 A2G | GCUGGCGCCUUUAUCUGAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2204 | truncated stem loop, C18G | UACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2205 | uvsX, trip mut (T10C), -1 A2G | GCUGGCGCCUUUAUCUCAUUACUUUGAGAGCCAUCACCAGCGACUAUGUCGUAUGGGUAAAGCGCCCUCUUCGGAGGGAAGCAUCAAAG |
| 2206 | truncated stem loop, -1 A2G | GCUGGCGCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2207 | short phage rep, trip mut (T10C), -1 A2G | GCUGGCGCCUUUAUCUCAUUACUUUGAGAGCCAUCACCAGCGACUAUGUCGUAUGGGUAAAGCGCGGACGACCUCUCGGUCGUCCGAAGCAUCAAAG |
| 2208 | 5' HDV ribozyme (Owen Ryan, Jamie Cate) | GAUGGCCGGCAUGGUCCCAGCCUCCUCGCUGGCGCCGGCUGGGCAACACCUUCGGGUGGCGAAUGGGACUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2209 | 5' HDV genomic ribozyme | GGCCGGCAUGGUCCCAGCCUCCUCGCUGGCGCCGGCUGGGCAACAUUCCGAGGGGACCGUCCCCUCGGUAAUGGCGAAUGGGACCCUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2210 | truncated stem loop, C18G, trip mut (T10C), -1 A2G, HDV AA(98:99)C | GCUGGCGCCUUUAUCUGAUUACUUUGAGAGCCAUCACCAGCGACUAUGUCGUAUGGGUAAAGCGCUUACGGACUUCGGUCCGUAAGCGCAUCAAAG |
| 2211 | 5' env25 pistol ribozyme (with an added CUUCGG loop) | CGUGGUUAGGGCCACGUUAAAUAGUUGCUUAAGCCCUAAGCGUUGAUCUUCGGAUCAGGUGCAAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |

TABLE 2-continued

Exemplary gNA Variant Scaffold Sequences

| SEQ ID NO: | NAME or Modification | NUCLEOTIDE SEQUENCE |
|---|---|---|
| 2212 | 5' HDV antigenomic ribozyme | GGGUCGGCAUGGCAUCUCCACCUCCUCGCGGUCCGACCUGGGCAUCCGAAGGAGGACGCACGUCCACUCGGAUGGCUAAGGGAGAGCCAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2213 | 3' Hammerhead ribozyme (Lior Nissim, Timothy Lu) guide scaffold scar | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCCAGUACUGAUGAGUCCGUGAGGACGAAACGAGUAAGCUCGUCUACUGGCGCUUUUAUCUCAU |
| 2214 | =+A27, stacked onto 64 | UACUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2215 | 5' Hammerhead ribozyme (Lior Nissim, Timothy Lu) smaller scar | CGACUACUGAUGAGUCCGUGAGGACGAAACGAGUAAGCUCGUCUAGUCGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2216 | phage rep loop, C18G, trip mut (T10C), -1 A2G, HDV AA(98:99)C | GCUGGCGCCUUUAUCUGAUUACUUUGAGAGCCAUCACCAGCGACUAUGUCGUAUGGGUAAAGCGCAGGUGGGACGACCUCUCGGUCGUCCUAUCUGCGCAUCAAAG |
| 2217 | -27, stacked onto 64 | UACUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2218 | 3' Hatchet | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCAUUCCUCAGAAAAUGACAAACCUGUGGGGCGUAAGUAGAUCUUCGGAUCUAUGAUCGUGCAGACGUUAAAAUCAGGU |
| 2219 | 3' Hammerhead ribozyme (Lior Nissim, Timothy Lu) | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCGACUACUGAUGAGUCCGUGAGGACGAAACGAGUAAGCUCGUCUAGUCGCGUGUAGCGAAGCA |
| 2220 | 5' Hatchet | CAUUCCUCAGAAAAUGACAAACCUGUGGGGCGUAAGUAGAUCUUCGGAUCUAUGAUCGUGCAGACGUUAAAAUCAGGUUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2221 | 5' HDV ribozyme (Lior Nissim, Timothy Lu) | UUUUGGCCGGCAUGGUCCCAGCCUCCUCGCUGGCGCCGGCUGGGCAACAUGCUUCGGCAUGGCGAAUGGGACCCCGGGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2222 | 5' Hammerhead ribozyme (Lior Nissim, Timothy Lu) | CGACUACUGAUGAGUCCGUGAGGACGAAACGAGUAAGCUCGUCUAGUCGCGUGUAGCGAAGCAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2223 | 3' HH15 Minimal Hammerhead ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGGGGGAGCCCCGCUGAUGAGGUCGGGGAGACCGAAAGGGACUUCGGUCCCUACGGGGCUCCC |
| 2224 | 5' RBMX recruiting motif | CCACCCCCACCACCACCCCCACCCCCACCACCACCCUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2225 | 3' Hammerhead ribozyme (Lior Nissim, Timothy Lu) smaller scar | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCGACUACUGAUGAGUCCGUGAGGACGAAACGAGUAAGCUCGUCUAGUCG |
| 2226 | 3' env25 pistol ribozyme (with an added CUUCGG loop) | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCGUGGUUAGGGCCACGUUAAAUAGUUGCUUAAGCCCUAAGCGUUGAUCUUCGGAUCAGGUGCAA |

TABLE 2-continued

Exemplary gNA Variant Scaffold Sequences

| SEQ ID NO: | NAME or Modification | NUCLEOTIDE SEQUENCE |
|---|---|---|
| 2227 | 3' Env-9 Twister | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGCA AUAAAGCGGUUACAAGCCCGCAAAAAUAGCAGAGUAAUGUCGCGAUAGCGCGGCAU UAAUGCAGCUUUAUUG |
| 2228 | =+ATTATCTCA TTACT25 | UACUGGCGCUUUUAUCUCAUUACUAUUAUCUCAUUACUUUGAGAGCCAUCACCAGC GACUAUGUCGUAUGGGUAAAGCGCUUAUUUAUCGGAGAGAAAUCCGAUAAAUAAGA AGCAUCAAAG |
| 2229 | 5' Env-9 Twister | GGCAAUAAAGCGGUUACAAGCCCGCAAAAAUAGCAGAGUAAUGUCGCGAUAGCGCG GCAUUAAUGCAGCUUUAUUGUACUGGCGCUUUUAUCUCAUUACUUUGAGAGCCAUC ACCAGCGACUAUGUCGUAUGGGUAAAGCGCUUAUUUAUCGGAGAGAAAUCCGAUAA AUAAGAAGCAUCAAAG |
| 2230 | 3' Twisted Sister 1 | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGACCC GCAAGGCCGACGGCAUCCGCCGCCGCUGGUGCAAGUCCAGCCGCCCCUUCGGGGGC GGGCGCUCAUGGGUAAC |
| 2231 | no stem | UACUGGCGCUUUUAUCUCAUUACUUUGAGAGCCAUCACCAGCGACUAUGUCGUAUG GGUAAAG |
| 2232 | 5' HH15 Minimal Hammerhead ribozyme | GGGAGCCCCGCUGAUGAGGUCGGGGAGACCGAAAGGGACUUCGGUCCCUACGGGGC UCCCUACUGGCGCUUUUAUCUCAUUACUUUGAGAGCCAUCACCAGCGACUAUGUCG UAUGGGUAAAGCGCUUAUUUAUCGGAGAGAAAUCCGAUAAAUAAGAAGCAUCAAAG |
| 2233 | 5' Hammerhead ribozyme (Lior Nissim, Timothy Lu) guide scaffold scar | CCAGUACUGAUGAGUCCGUGAGGACGAAACGAGUAAGCUCGUCUACUGGCGCUUUU AUCUCAUUACUGGCGCUUUUAUCUCAUUACUUUGAGAGCCAUCACCAGCGACUAUG UCGUAUGGGUAAAGCGCUUAUUUAUCGGAGAGAAAUCCGAUAAAUAAGAAGCAUCA AAG |
| 2234 | 5' Twisted Sister 1 | ACCCGCAAGGCCGACGGCAUCCGCCGCCGCUGGUGCAAGUCCAGCCGCCCCUUCGG GGGCGGGCGCUCAUGGGUAACUACUGGCGCUUUUAUCUCAUUACUUUGAGAGCCAU CACCAGCGACUAUGUCGUAUGGGUAAAGCGCUUAUUUAUCGGAGAGAAAUCCGAUA AAUAAGAAGCAUCAAAG |
| 2235 | 5' sTRSV WT viral Hammerhead ribozyme | CCUGUCACCGGAUGUGCUUUCCGGUCUGAUGAGUCCGUGAGGACGAAACAGGUACU GGCGCUUUUAUCUCAUUACUUUGAGAGCCAUCACCAGCGACUAUGUCGUAUGGGUA AAGCGCUUAUUUAUCGGAGAGAAAUCCGAUAAAUAAGAAGCAUCAAAG |
| 2236 | 148, =+G55, stacked onto 64 | GUACUGGCGCCUUUAUCUCAUUACUUUGAGAGCCAUCACCAGCGACUAUGUCGUAG UGGGUAAAGCGCUUACGGACUUCGGUCCGUAAGAAGCAUCAAAG |
| 2237 | 158, 103 + 148(+G55) -99, G65U | GUACUGGCGCUUUUAUCUGAUUACUUUGAGAGCCAUCACCAGCGACUAUGUCGUAG UGGGUAAAGCUCCCUCUUCGGAGGGAGCAUCAAAG |
| 2238 | 174, Uvsx Extended stem with [A99] G65U], C18G, ^G55, [GT-1] | ACUGGCGCUUUUAUCUGAUUACUUUGAGAGCCAUCACCAGCGACUAUGUCGUAGUG GGUAAAGCUCCCUCUUCGGAGGGAGCAUCAAAG |
| 2239 | 175, extended stem truncation, T10C, [GT-1] | ACUGGCGCCUUUAUCUCAUUACUUUGAGAGCCAUCACCAGCGACUAUGUCGUAUGG GUAAAGCGCUUACGGACUUCGGUCCGUAAGAAGCAUCAAAG |
| 2240 | 176, 174 with A1G substitution for T7 transcription | GCUGGCGCUUUUAUCUGAUUACUUUGAGAGCCAUCACCAGCGACUAUGUCGUAGUG GGUAAAGCUCCCUCUUCGGAGGGAGCAUCAAAG |
| 2241 | 177, 174 with bubble (+G55) removed | ACUGGCGCUUUUAUCUGAUUACUUUGAGAGCCAUCACCAGCGACUAUGUCGUAUGG GUAAAGCUCCCUCUUCGGAGGGAGCAUCAAAG |
| 2242 | 181, stem 42 (truncated stem loop); T10C, C18G, [GT -1](95 + [GT-1]) | ACUGGCGCUUUUAUCUGAUUACUUUGAGAGCCAUCACCAGCGACUAUGUCGUAUGG GUAAAGCGCUUACGGACUUCGGUCCGUAAGAAGCAUCAAAG |

TABLE 2-continued

Exemplary gNA Variant Scaffold Sequences

| SEQ ID NO: | NAME or Modification | NUCLEOTIDE SEQUENCE |
|---|---|---|
| 2243 | 182, stem 42 (truncated stem loop); C18G, [GT-1] | ACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2244 | 183, stem 42 (truncated stem loop); C18G, ^G55, [GT-1] | ACUGGCGCUUUUAUCUGAUUACUUUGAGAGCCAUCACCAGCGACUAUGUCGUAGUGGGUAAAGCGCUUACGGACUUCGGUCCGUAAGAAGCAUCAAAG |
| 2245 | 184, stem 48 (uvsx, -99 g65t); C18G, ^T55, [GT-1] | ACUGGCGCUUUUAUCUGAUUACUUUGAGAGCCAUCACCAGCGACUAUGUCGUAUUGGGUAAAGCUCCCUCUUCGGAGGGAGCAUCAAAG |
| 2246 | 185, stem 42 (truncated stem loop); C18G, ^T55, [GT-1] | ACUGGCGCUUUUAUCUGAUUACUUUGAGAGCCAUCACCAGCGACUAUGUCGUAUUGGGUAAAGCGCUUACGGACUUCGGUCCGUAAGAAGCAUCAAAG |
| 2247 | 186, stem 42 (truncated stem loop); T10C, ^A17, [GT-1] | ACUGGCGCCUUUAUCAUCAUUACUUUGAGAGCCAUCACCAGCGACUAUGUCGUAUGGGUAAAGCGCUUACGGACUUCGGUCCGUAAGAAGCAUCAAAG |
| 2248 | 187, stem 46 (uvsx); C18G, ^G55, [GT-1] | ACUGGCGCUUUUAUCUGAUUACUUUGAGAGCCAUCACCAGCGACUAUGUCGUAGUGGGUAAAGCGCCCUCUUCGGAGGGAAGCAUCAAAG |
| 2249 | 188, stem 50 (ms2 U15C, -99, g65t); C18G, ^G55, [GT-1] | ACUGGCGCUUUUAUCUGAUUACUUUGAGAGCCAUCACCAGCGACUAUGUCGUAGUGGGUAAAGCUCACAUGAGGAUCACCCAUGUGAGCAUCAAAG |
| 2250 | 189, 174 + G8A; T15C; T35A | ACUGGCACUUUUACCUGAUUACUUUGAGAGCCAACACCAGCGACUAUGUCGUAGUGGGUAAAGCUCCCUCUUCGGAGGGAGCAUCAAAG |
| 2251 | 190, 174 + G8A | ACUGGCACUUUUAUCUGAUUACUUUGAGAGCCAUCACCAGCGACUAUGUCGUAGUGGGUAAAGCUCCCUCUUCGGAGGGAGCAUCAAAG |
| 2252 | 191, 174 + G8C | ACUGGCCCUUUUAUCUGAUUACUUUGAGAGCCAUCACCAGCGACUAUGUCGUAGUGGGUAAAGCUCCCUCUUCGGAGGGAGCAUCAAAG |
| 2253 | 192, 174 + T15C | ACUGGCGCUUUUACCUGAUUACUUUGAGAGCCAUCACCAGCGACUAUGUCGUAGUGGGUAAAGCUCCCUCUUCGGAGGGAGCAUCAAAG |
| 2254 | 193, 174 + T35A | ACUGGCGCUUUUAUCUGAUUACUUUGAGAGCCAACACCAGCGACUAUGUCGUAGUGGGUAAAGCUCCCUCUUCGGAGGGAGCAUCAAAG |
| 2255 | 195, 175 + C18G + G8A; T15C; T35A | ACUGGCACCUUUUACCUGAUUACUUUGAGAGCCAACACCAGCGACUAUGUCGUAUGGGUAAAGCGCUUACGGACUUCGGUCCGUAAGAAGCAUCAAAG |
| 2256 | 196, 175 + C18G + G8A | ACUGGCACCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2257 | 197, 175 + C18G + G8C | ACUGGCCCCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2258 | 198, 175 + C18G + T35A | ACUGGCGCCUUUUAUCUGAUUACUUUGAGAGCCAACACCAGCGACUAUGUCGUAUGGGUAAAGCGCUUACGGACUUCGGUCCGUAAGAAGCAUCAAAG |
| 2259 | 199, 174 + A2G (test G transcription at start; ccGCT...) | GCUGGCGCUUUUAUCUGAUUACUUUGAGAGCCAUCACCAGCGACUAUGUCGUAGUGGGUAAAGCUCCCUCUUCGGAGGGAGCAUCAAAG |
| 2260 | 200, 174 + ^G1 (ccGACT...) | GACUGGCGCUUUUAUCUGAUUACUUUGAGAGCCAUCACCAGCGACUAUGUCGUAGUGGGUAAAGCUCCCUCUUCGGAGGGAGCAUCAAAG |

TABLE 2-continued

Exemplary gNA Variant Scaffold Sequences

| SEQ ID NO: | NAME or Modification | NUCLEOTIDE SEQUENCE |
|---|---|---|
| 2261 | 201, 174 + T10C; ^G28 | ACUGGCGCCUUUAUCUGAUUACUUUGGAGAGCCAUCACCAGCGACUAUGUCGUAGU GGGUAAAGCUCCCUCUUCGGAGGGAGCAUCAAAG |
| 2262 | 202, 174 + T10A; A28T | ACUGGCGCAUUUAUCUGAUUACUUUGUGAGCCAUCACCAGCGACUAUGUCGUAGUG GGUAAAGCUCCCUCUUCGGAGGGAGCAUCAAAG |
| 2263 | 203, 174 + T10C | ACUGGCGCCUUUAUCUGAUUACUUUGAGAGCCAUCACCAGCGACUAUGUCGUAGUG GGUAAAGCUCCCUCUUCGGAGGGAGCAUCAAAG |
| 2264 | 204, 174 + ^G28 | ACUGGCGCUUUUAUCUGAUUACUUUGGAGAGCCAUCACCAGCGACUAUGUCGUAGU GGGUAAAGCUCCCUCUUCGGAGGGAGCAUCAAAG |
| 2265 | 205, 174 + T10A | ACUGGCGCAUUUAUCUGAUUACUUUGAGAGCCAUCACCAGCGACUAUGUCGUAGUG GGUAAAGCUCCCUCUUCGGAGGGAGCAUCAAAG |
| 2266 | 206, 174 + A28T | ACUGGCGCUUUUAUCUGAUUACUUUGUGAGCCAUCACCAGCGACUAUGUCGUAGUG GGUAAAGCUCCCUCUUCGGAGGGAGCAUCAAAG |
| 2267 | 207, 174 + ^T15 | ACUGGCGCUUUUAUUCUGAUUACUUUGAGAGCCAUCACCAGCGACUAUGUCGUAGU GGGUAAAGCUCCCUCUUCGGAGGGAGCAUCAAAG |
| 2268 | 208, 174 + [T4] | ACGGCGCUUUUAUCUGAUUACUUUGAGAGCCAUCACCAGCGACUAUGUCGUAGUGG GUAAAGCUCCCUCUUCGGAGGGAGCAUCAAAG |
| 2269 | 209, 174 + C16A | ACUGGCGCUUUUAUAUGAUUACUUUGAGAGCCAUCACCAGCGACUAUGUCGUAGUG GGUAAAGCUCCCUCUUCGGAGGGAGCAUCAAAG |
| 2270 | 210, 174 + ^T17 | ACUGGCGCUUUUAUCUUGAUUACUUUGAGAGCCAUCACCAGCGACUAUGUCGUAGU GGGUAAAGCUCCCUCUUCGGAGGGAGCAUCAAAG |
| 2271 | 211, 174 + T35G (compare with 174 + T35A above) | ACUGGCGCUUUUAUCUGAUUACUUUGAGAGCCAGCACCAGCGACUAUGUCGUAGUG GGUAAAGCUCCCUCUUCGGAGGGAGCAUCAAAG |
| 2272 | 212, 174 + U11G, A105G (A86G), U26C | ACUGGCGCUGUUAUCUGAUUACUUCGAGAGCCAUCACCAGCGACUAUGUCGUAGUG GGUAAAGCUCCCUCUUCGGAGGGAGCAUCGAAG |
| 2273 | 213, 174 + U11C, A105G (A86G), U26C | ACUGGCGCUCUUAUCUGAUUACUUCGAGAGCCAUCACCAGCGACUAUGUCGUAGUG GGUAAAGCUCCCUCUUCGGAGGGAGCAUCGAAG |
| 2274 | 214, 174 + U12G; A106G (A87G), U25C | ACUGGCGCUUGUAUCUGAUUACUCUGAGAGCCAUCACCAGCGACUAUGUCGUAGUG GGUAAAGCUCCCUCUUCGGAGGGAGCAUCAGAG |
| 2275 | 215, 174 + U12C; A106G (A87G), U25C | ACUGGCGCUUCUAUCUGAUUACUCUGAGAGCCAUCACCAGCGACUAUGUCGUAGUG GGUAAAGCUCCCUCUUCGGAGGGAGCAUCAGAG |
| 2276 | 216, 174_tx_tt.G,87.G,22.C | ACUGGCGCUUUGAUCUGAUUACCUUGAGAGCCAUCACCAGCGACUAUGUCGUAGUG GGUAAAGCUCCCUCUUCGGAGGGAGCAUCAAGG |
| 2277 | 217, 174_tx_11.C,87.G,22.C | ACUGGCGCUUUCAUCUGAUUACCUUGAGAGCCAUCACCAGCGACUAUGUCGUAGUG GGUAAAGCUCCCUCUUCGGAGGGAGCAUCAAGG |
| 2278 | 218, 174 + U11G | ACUGGCGCUGUUAUCUGAUUACUUUGAGAGCCAUCACCAGCGACUAUGUCGUAGUG GGUAAAGCUCCCUCUUCGGAGGGAGCAUCAAAG |
| 2279 | 219, 174 + A105G (A86G) | ACUGGCGCUUUUAUCUGAUUACUUUGAGAGCCAUCACCAGCGACUAUGUCGUAGUG GGUAAAGCUCCCUCUUCGGAGGGAGCAUCGAAG |
| 2280 | 220, 174 + U26C | ACUGGCGCUUUUAUCUGAUUACUUCGAGAGCCAUCACCAGCGACUAUGUCGUAGUG GGUAAAGCUCCCUCUUCGGAGGGAGCAUCAAAG |

In some embodiments, the gNA variant comprises a tracrRNA stem loop comprising the sequence -UUU-N4-25-UUU- (SEQ ID NO: 240). For example, the gNA variant comprises a scaffold stem loop or a replacement thereof, flanked by two triplet U motifs that contribute to the triplex region. In some embodiments, the scaffold stem loop or replacement thereof comprises at least 4 nucleotides, at least 5 nucleotides, at least 6 nucleotides, at least 7 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides.

In some embodiments, the gNA variant comprises a crRNA sequence with -AAAG- in a location 5' to the spacer region. In some embodiments, the -AAAG- sequence is immediately 5' to the spacer region.

In some embodiments, the at least one nucleotide modification to a reference gNA to produce a gNA variant comprises at least one nucleotide deletion in the CasX variant gNA relative to the reference gRNA. In some embodiments, a gNA variant comprises a deletion of 1, 2, 3, 4, 5, 6, 7, 8, 9, 10, 11, 12, 13, 14, 15, 16, 17, 18, 19 or 20 consecutive or non-consecutive nucleotides relative to a reference gNA. In some embodiments, the at least one deletion comprises a deletion of 1, 2, 3, 4, 5, 6, 7, 8, 9, 10, 11, 12, 13, 14, 15, 16, 17, 18, 19 or 20 or more consecutive nucleotides relative to a reference gNA. In some embodiments, the gNA variant comprises 2, 3, 4, 5, 6, 7, 8, 9, 10, 11, 12, 13, 14, 15, 16, 17, 18, 19 or 20 or more nucleotide deletions relative to the reference gNA, and the deletions are not in consecutive nucleotides. In those embodiments where there are two or more non-consecutive deletions in the gNA variant relative to the reference gRNA, any length of deletions, and any combination of lengths of deletions, as described herein, are contemplated as within the scope of the disclosure. For example, in some embodiments, a gNA variant may comprise a first deletion of one nucleotide, and a second deletion of two nucleotides and the two deletions are not consecutive. In some embodiments, a gNA variant comprises at least two deletions in different regions of the reference gRNA. In some embodiments, a gNA variant comprises at least two deletions in the same region of the reference gRNA. For example, the regions may be the extended stem loop, scaffold stem loop, scaffold stem bubble, triplex loop, pseudoknot, triplex, or a 5' end of the gNA variant. The deletion of any nucleotide in a reference gRNA is contemplated as within the scope of the disclosure.

In some embodiments, the at least one nucleotide modification of a reference gRNA to generate a gNA variant comprises at least one nucleotide insertion. In some embodiments, a gNA variant comprises an insertion of 1, 2, 3, 4, 5, 6, 7, 8, 9 or 10 consecutive or non-consecutive nucleotides relative to a reference gRNA. In some embodiments, the at least one nucleotide insertion comprises an insertion of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more insertions relative to the reference gRNA, and the insertions are not consecutive. In those embodiments where there are two or more non-consecutive insertions in the gNA variant relative to the reference gRNA, any length of insertions, and any combination of lengths of insertions, as described herein, are contemplated as within the scope of the disclosure. For example, in some embodiments, a gNA variant may comprise a first insertion of one nucleotide, and a second insertion of two nucleotides and the two insertions are not consecutive. In some embodiments, a gNA variant comprises at least two insertions in different regions of the reference gRNA. In some embodiments, a gNA variant comprises at least two insertions in the same region of the reference gRNA. For example, the regions may be the extended stem loop, scaffold stem loop, scaffold stem bubble, triplex loop, pseudoknot, triplex, or a 5' end of the gNA variant. Any insertion of A, G, C, U (or T, in the corresponding DNA) or combinations thereof at any location in the reference gRNA is contemplated as within the scope of the disclosure.

In some embodiments, the at least one nucleotide modification of a reference gRNA to generate a gNA variant comprises at least one nucleic acid substitution. In some embodiments, a gNA variant comprises 1, 2, 3, 4, 5, 6, 7, 8, 9, 10, 11, 12, 13, 14, 15, 16, 17, 18, 19 or 20 or more consecutive or non-consecutive substituted nucleotides relative to a reference gRNA. In some embodiments, a gNA variant comprises 1-4 nucleotide substitutions relative to a reference gRNA. In some embodiments, the at least one substitution comprises a substitution of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more substitutions relative to the reference gRNA, and the substitutions are not consecutive. In those embodiments where there are two or more non-consecutive substitutions in the gNA variant relative to the reference gRNA, any length of substituted nucleotides, and any combination of lengths of substituted nucleotides, as described herein, are contemplated as within the scope of the disclosure. For example, in some embodiments, a gNA variant may comprise a first substitution of one nucleotide, and a second substitution of two nucleotides and the two substitutions are not consecutive. In some embodiments, a gNA variant comprises at least two substitutions in different regions of the reference gRNA. In some embodiments, a gNA variant comprises at least two substitutions in the same region of the reference gRNA. For example, the regions may be the triplex, the extended stem loop, scaffold stem loop, scaffold stem bubble, triplex loop, pseudoknot, triplex, or a 5' end of the gNA variant. Any substitution of A, G, C, U (or T, in the corresponding DNA) or combinations thereof at any location in the reference gRNA is contemplated as within the scope of the disclosure.

Any of the substitutions, insertions and deletions described herein can be combined to generate a gNA variant of the disclosure. For example, a gNA variant can comprise at least one substitution and at least one deletion relative to a reference gRNA, at least one substitution and at least one insertion relative to a reference gRNA, at least one insertion and at least one deletion relative to a reference gRNA, or at least one substitution, one insertion and one deletion relative to a reference gRNA.

In some embodiments, the gNA variant comprises a scaffold region at least 20% identical, at least 30% identical, at least 40% identical, at least 50% identical, at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to any one of SEQ ID NOS: 4-16. In some embodiments, the gNA variant comprises a scaffold region at least 60% homologous (or identical) to any one of SEQ ID NOS: 4-16.

In some embodiments, the gNA variant comprises a tracr stem loop at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to SEQ ID NO: 14. In some embodiments, the gNA variant comprises a tracr stem loop at least 60% homologous (or identical) to SEQ ID NO: 14.

In some embodiments, the gNA variant comprises an extended stem loop at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to SEQ ID NO: 15. In some embodiments, the gNA variant comprises an extended stem loop at least 60% homologous (or identical) to SEQ ID NO: 15.

In some embodiments, a gNA variant comprises a sequence of any one of SEQ ID NOs: 412-3295. In some embodiments, a gNA variant comprises a sequence of any one of SEQ ID NOS: 2236, 2237, 2238, 2241, 2244, 2248, 2249, or 2259-2280. In some embodiments, a gNA variant comprises a sequence of any one of SEQ ID NOS: 2236, 2237, 2238, 2241, 2244, 2248, 2249, or 2259-2280.

In some embodiments, the gNA variant comprises an exogenous extended stem loop, with such differences from a reference gNA described as follows. In some embodiments, an exogenous extended stem loop has little or no identity to the reference stem loop regions disclosed herein (e.g., SEQ ID NO: 15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, at least 500 bp, at least 600 bp, at least 700 bp, at least 800 bp, at least 900 bp, at least 1,000 bp, at least 2,000 bp, at least 3,000 bp, at least 4,000 bp, at least 5,000 bp, at least 6,000 bp, at least 7,000 bp, at least 8,000 bp, at least 9,000 bp, at least 10,000 bp, at least 12,000 bp, at least 15,000 bp or at least 20,000 bp. In some embodiments, the gNA variant comprises an extended stem loop region comprising at least 10, at least 100, at least 500, at least 1000, or at least 10,000 nucleotides. In some embodiments, the heterologous stem loop increases the stability of the gNA. In some embodiments, the heterologous RNA stem loop is capable of binding a protein, an RNA structure, a DNA sequence, or a small molecule. In some embodiments, an exogenous stem loop region comprises an RNA stem loop or hairpin, for example a thermostable RNA such as MS2 (ACAUGAGGAUUACCCAUGU; SEQ ID NO: 4278), Qβ (UGCAUGUCUAAGACAGCA; SEQ ID NO: 4279), U1 hairpin II (AAUCCAUUGCACUCCG-GAUU; SEQ ID NO:4280), Uvsx (CCUCUUCGGAGG; SEQ ID NO: 4281), PP7 (AGGAGUUUCUAUG-GAAACCCU; SEQ ID NO: 4282), Phage replication loop (AGGUGGGACGACCUCUCGGUCGUCCUAUCU; SEQ ID NO: 4283), Kissing loop_a (UGCUCG-CUCCGUUCGAGCA; SEQ ID NO: 4284), Kissing loop_b1 (UGCUCGACGCGUCCUCGAGCA; SEQ ID NO: 4285), Kissing loop_b2 (UGCUCGUUUGCGGC-UACGAGCA; SEQ ID NO: 4286), G quadriplex M3q (AGGGAGGGAGGGAGAGG; SEQ ID NO: 4287), G quadriplex telomere basket (GGUUAGGGUUAGG-GUUAGG; SEQ ID NO: 4288), Sarcin-ricin loop (CUG-CUCAGUACGAGAGGAACCGCAG; SEQ ID NO: 4289) or Pseudoknots (UACACUGGGAUCGCUGAAUUA-GAGAUCGGCGUCCUUUCAUUCUAUAUACUUU GGAGUUUUAAAAUGUCUCUAAGUACA; SEQ ID NO: 4290). In some embodiments, an exogenous stem loop comprises an RNA scaffold. As used herein, an "RNA scaffold" refers to a multi-dimensional RNA structure capable of interacting with and organizing or localizing one or more proteins. In some embodiments, the RNA scaffold is synthetic or non-naturally occurring. In some embodiments, an exogenous stem loop comprises a long non-coding RNA (lncRNA). As used herein, a lncRNA refers to a non-coding RNA that is longer than approximately 200 bp in length. In some embodiments, the 5' and 3' ends of the exogenous stem loop are base paired, i.e., interact to form a region of duplex RNA. In some embodiments, the 5' and 3' ends of the exogenous stem loop are base paired, and one or more regions between the 5' and 3' ends of the exogenous stem loop are not base paired. In some embodiments, the at least one nucleotide modification comprises: (a) substitution of 1 to 15 consecutive or non-consecutive nucleotides in the gNA variant in one or more regions; (b) a deletion of 1 to 10 consecutive or non-consecutive nucleotides in the gNA variant in one or more regions; (c) an insertion of 1 to 10 consecutive or non-consecutive nucleotides in the gNA variant in one or more regions; (d) a substitution of the scaffold stem loop or the extended stem loop with an RNA stem loop sequence from a heterologous RNA source with proximal 5' and 3' ends; or any combination of (a)-(d).

In some embodiments, a gNA variant comprises a sequence or subsequence of any one of SEQ ID NOs: 412-3295 and an a sequence of an exogenous stem loop. In some embodiments, a gNA variant comprises a sequence or subsequence of any one of SEQ ID NOS: 2236, 2237, 2238, 2241, 2244, 2248, 2249, or 2259-2280 and a sequence of an exogenous stem loop. In some embodiments, a gNA variant comprises a sequence or subsequence of any one of SEQ ID NOS: 2236, 2237, 2238, 2241, 2244, 2248, 2249, or 2259-2280 and a sequence of an exogenous stem loop.

In some embodiments, the gNA variant comprises a scaffold stem loop having at least 60% identity to SEQ ID NO: 14. In some embodiments, the gNA variant comprises a scaffold stem loop having at least 60% identity, at least 70% identity, at least 80% identity, at least 90% identity, at least 95% identity, at least 98% identity or at least 99% identity to SEQ ID NO: 14. In some embodiments, the gNA variant comprises a scaffold stem loop comprising SEQ ID NO: 14.

In some embodiments, the gNA variant comprises a scaffold stem loop sequence of CCAGCGACUAUGU-CGUAGUGG (SEQ ID NO: 245). In some embodiments, the gNA variant comprises a scaffold stem loop sequence of CCAGCGACUAUGUCGUAGUGG (SEQ ID NO: 245) with at least 1, 2, 3, 4, or 5 mismatches thereto.

In some embodiments, the gNA variant comprises an extended stem loop region comprising less than 32 nucleotides, less than 31 nucleotides, less than 30 nucleotides, less than 29 nucleotides, less than 28 nucleotides, less than 27 nucleotides, less than 26 nucleotides, less than 25 nucleotides, less than 24 nucleotides, less than 23 nucleotides, less than 22 nucleotides, less than 21 nucleotides, or less than 20 nucleotides. In some embodiments, the gNA variant comprises an extended stem loop region comprising less than 32 nucleotides. In some embodiments, the gNA variant further comprises a thermostable stem loop.

In some embodiments, a sgRNA variant comprises a sequence of SEQ ID NO: 2104, 2106, SEQ ID NO: 2163, SEQ ID NO: 2107, SEQ ID NO: 2164, SEQ ID NO: 2165, SEQ ID NO: 2166, SEQ ID NO: 2103, SEQ ID NO: 2167, SEQ ID NO: 2105, SEQ ID NO: 2108, SEQ ID NO: 2112, SEQ ID NO: 2160, SEQ ID NO: 2170, SEQ ID NO: 2114, SEQ ID NO: 2171, SEQ ID NO: 2112, SEQ ID NO: 2173, SEQ ID NO: 2102, SEQ ID NO: 2174, SEQ ID NO: 2175, SEQ ID NO: 2109, SEQ ID NO: 2176, SEQ ID NO: 2238, SEQ ID NO: 2239, SEQ ID NO: 2240, or SEQ ID NO: 2241.

In some embodiments, the gNA variant comprises one or more additional changes to a sequence of any one of SEQ ID NOs: 2201-2280. In some embodiments, the gNA variant comprises a sequence of any one of SEQ ID NOS: 2236, 2237, 2238, 2241, 2244, 2248, 2249, or 2259-2280, or having at least about 80%, at least about 90%, at least about 95%, at least about 96%, at least about 97%, at least about 98%, at least about 99% identity thereto. In some embodiments, the gNA variant comprises one or more additional changes to a sequence of any one of SEQ ID NOs: 2201-2280. In some embodiments, the gNA variant comprises the sequence of any one of SEQ ID NOS: 2236, 2237, 2238, 2241, 2244, 2248, 2249, or 2259-2280.

In some embodiments, a sgRNA variant comprises one or more additional changes to a sequence of SEQ ID NO: 2104, SEQ ID NO: 2163, SEQ ID NO: 2107, SEQ ID NO: 2164, SEQ ID NO: 2165, SEQ ID NO: 2166, SEQ ID NO: 2103, SEQ ID NO: 2167, SEQ ID NO: 2105, SEQ ID NO: 2108, SEQ ID NO: 2112, SEQ ID NO: 2160, SEQ ID NO: 2170, SEQ ID NO: 2114, SEQ ID NO: 2171, SEQ ID NO: 2112, SEQ ID NO: 2173, SEQ ID NO: 2102, SEQ ID NO: 2174, SEQ ID NO: 2175, SEQ ID NO: 2109, SEQ ID NO: 2176, SEQ ID NO: 2238, SEQ ID NO: 2239, SEQ ID NO: 2240, or SEQ ID NO: 2241.

In some embodiments of the gNA variants of the disclosure, the gNA variant comprises at least one modification, wherein the at least one modification compared to the reference guide scaffold of SEQ ID NO: 5 is selected from one or more of: (a) a C18G substitution in the triplex loop; (b) a G55 insertion in the stem bubble; (c) a U1 deletion; (d) a modification of the extended stem loop wherein (i) a 6 nt loop and 13 loop-proximal base pairs are replaced by a Uvsx hairpin; and (ii) a deletion of A99 and a substitution of G65U that results in a loop-distal base that is fully base-paired. In such embodiments, the gNA variant comprises the sequence of any one of SEQ ID NOS: 2236, 2237, 2238, 2241, 2244, 2248, 2249, or 2259-2280.

In some embodiments, the scaffold of the gNA variant comprises the sequence of any one of SEQ ID NOS: 2201-2280 of Table 2. In some embodiments, the scaffold of the gNA consists or consists essentially of the sequence of any one of SEQ ID NOS: 2201-2280. In some embodiments, the scaffold of the gNA variant sequence is at least about 60% identical, at least about 65% identical, at least about 70% identical, at least about 75% identical, at least about 80% identical, at least about 85% identical, at least about 90% identical, at least about 91% identical, at least about 92% identical, at least about 93% identical, at least about 94% identical, at least about 95% identical, at least about 96% identical, at least about 97% identical, at least about 98% identical or at least about 99% identical to any one of SEQ ID NOS: 2201 to 2280.

In some embodiments, the gNA variant further comprises a spacer (or targeting sequence) region, described more fully, supra, which comprises at least 14 to about 35 nucleotides wherein the spacer is designed with a sequence that is complementary to a target DNA. In some embodiments, the gNA variant comprises a targeting sequence of at least 10 to 30 nucleotides complementary to a target DNA. In some embodiments, the targeting sequence has 14, 15, 16, 17, 18, 19, 20, 21, 22, 23, 24, 25, 26, 27, 28, 29, 30, 31, 32, 33, 34 or 35 nucleotides. In some embodiments, the gNA variant comprises a targeting sequence having 20 nucleotides. In some embodiments, the targeting sequence has 25 nucleotides. In some embodiments, the targeting sequence has 24 nucleotides. In some embodiments, the targeting sequence has 23 nucleotides. In some embodiments, the targeting sequence has 22 nucleotides. In some embodiments, the targeting sequence has 21 nucleotides. In some embodiments, the targeting sequence has 20 nucleotides. In some embodiments, the targeting sequence has 19 nucleotides. In some embodiments, the targeting sequence has 18 nucleotides. In some embodiments, the targeting sequence has 17 nucleotides. In some embodiments, the targeting sequence has 16 nucleotides. In some embodiments, the targeting sequence has 15 nucleotides. In some embodiments, the targeting sequence has 14 nucleotides.

In some embodiments, the scaffold of the gNA variant is a variant comprising one or more additional changes to a sequence of a reference gRNA that comprises SEQ ID NO: 4 or SEQ ID NO: 5. In those embodiments where the scaffold of the reference gRNA is derived from SEQ ID NO: 4 or SEQ ID NO: 5, the one or more improved or added characteristics of the gNA variant are improved compared to the same characteristic in SEQ ID NO: 4 or SEQ ID NO: 5.

In some embodiments, the scaffold of the gNA variant is part of an RNP with a reference CasX protein comprising SEQ ID NO: 1, SEQ ID NO: 2, or SEQ ID NO: 3. In other embodiments, the scaffold of the gNA variant is part of an RNP with a CasX variant protein comprising any one of the sequences of Tables 3, 8, 9, 10 and 12, or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto. In the foregoing embodiments, the gNA further comprises a spacer sequence.

h. Chemically Modified gNAs

In some embodiments, the disclosure provides chemically-modified gNAs. In some embodiments, the present disclosure provides a chemically-modified gNA that has guide NA functionality and has reduced susceptibility to cleavage by a nuclease. A gNA that comprises any nucleotide other than the four canonical ribonucleotides A, C, G, and U, or a deoxynucleotide, is a chemically modified gNA. In some cases, a chemically-modified gNA comprises any backbone or internucleotide linkage other than a natural phosphodiester internucleotide linkage. In certain embodiments, the retained functionality includes the ability of the modified gNA to bind to a CasX of any of the embodiments described herein. In certain embodiments, the retained functionality includes the ability of the modified gNA to bind to a target nucleic acid sequence. In certain embodiments, the retained functionality includes targeting a CasX protein or the ability of a pre-complexed RNP to bind to a target nucleic acid sequence. In certain embodiments, the retained functionality includes the ability to nick a target polynucleotide by a CasX-gNA. In certain embodiments, the retained functionality includes the ability to cleave a target nucleic acid sequence by a CasX-gNA. In certain embodiments, the retained functionality is any other known function of a gNA in a recombinant system with a CasX chimera protein of the embodiments of the disclosure.

In some embodiments, the disclosure provides a chemically-modified gNA in which a nucleotide sugar modification is incorporated into the gNA selected from the group consisting of 2'-O—$C_{1-4}$alkyl such as 2'-O-methyl ("2'-OMe"), 2'-deoxy ("2'-H"), 2'-O—$C_{1-3}$alkyl-O—$C_{1-3}$alkyl such as 2'-methoxyethyl ("2'-MOE"), 2'-fluoro ("2'-F"), 2'-amino ("2'-$NH_2$"), 2'-arabinosyl ("2'-arabino") nucleotide, 2'-F-arabinosyl ("2'-F-arabino") nucleotide, 2'-locked nucleic acid ("LNA") nucleotide, 2'-unlocked nucleic acid ("ULNA") nucleotide, a sugar in L form ("L-sugar"), and 4'-thioribosyl nucleotide. In other embodiments, an internucleotide linkage modification incorporated into the guide RNA is selected from the group consisting of: phosphorothioate "P(S)" (P(S)), phosphonocarboxylate $(P(CH_2)_n COOR)$ such as phosphonoacetate "PACE" ($P(CH_2COO—)$), thiophosphonocarboxylate $((S)P(CH_2)_n COOR)$ such as thiophosphonoacetate "thioPACE" $((S)P(CH_2)_n COO—)$, alkylphosphonate $(P(C_{1-3}alkyl))$ such as methylphosphonate —$P(CH_3)$, boranophosphonate $(P(BH_3))$, and phosphorodithioate $(P(S)_2)$.

In certain embodiments, the disclosure provides a chemically-modified gNA in which a nucleobase ("base") modification is incorporated into the gNA selected from the group consisting of: 2-thiouracil ("2-thioU"), 2-thiocytosine ("2-thioC"), 4-thiouracil ("4-thioU"), 6-thioguanine ("6-thioG"), 2-aminoadenine ("2-aminoA"), 2-aminopurine, pseudouracil, hypoxanthine, 7-deazaguanine, 7-deaza-8-azaguanine, 7-deazaadenine, 7-deaza-8-azaadenine, 5-methylcytosine ("5-methylC"), 5-methyluracil ("5-methylU"), 5-hydroxymethylcytosine, 5-hydroxymethyluracil, 5,6-dehydrouracil, 5-propynylcytosine, 5-propynyluracil, 5-ethynylcytosine, 5-ethynyluracil, 5-allyluracil ("5-allylU"), 5-allylcytosine ("5-allylC"), 5-aminoallyluracil ("5-aminoallylU"), 5-aminoallyl-cytosine ("5-aminoallylC"), an abasic nucleotide, Z base, P base, Unstructured Nucleic Acid ("UNA"), isoguanine ("isoG"), isocytosine ("isoC"), 5-methyl-2-pyrimidine, x(A,G,C,T) and y(A,G,C,T).

In other embodiments, the disclosure provides a chemically-modified gNA in which one or more isotopic modifications are introduced on the nucleotide sugar, the nucleobase, the phosphodiester linkage and/or the nucleotide phosphates, including nucleotides comprising one or more $^{15}N$, $^{13}C$, $^{14}C$, deuterium, $^3H$, $^{32}P$, $^{125}I$, $^{131}I$ atoms or other atoms or elements used as tracers.

In some embodiments, an "end" modification incorporated into the gNA is selected from the group consisting of: PEG (polyethyleneglycol), hydrocarbon linkers (including: heteroatom (O,S,N)-substituted hydrocarbon spacers; halo-substituted hydrocarbon spacers; keto-, carboxyl-, amido-, thionyl-, carbamoyl-, thionocarbamaoyl-containing hydrocarbon spacers), spermine linkers, dyes including fluorescent dyes (for example fluoresceins, rhodamines, cyanines) attached to linkers such as, for example 6-fluorescein-hexyl, quenchers (for example dabcyl, BHQ) and other labels (for example biotin, digoxigenin, acridine, streptavidin, avidin, peptides and/or proteins). In some embodiments, an "end" modification comprises a conjugation (or ligation) of the gNA to another molecule comprising an oligonucleotide of deoxynucleotides and/or ribonucleotides, a peptide, a protein, a sugar, an oligosaccharide, a steroid, a lipid, a folic acid, a vitamin and/or other molecule. In certain embodiments, the disclosure provides a chemically-modified gNA in which an "end" modification (described above) is located internally in the gNA sequence via a linker such as, for example, a 2-(4-butylamidofluorescein)propane-1,3-diol bis (phosphodiester) linker, which is incorporated as a phosphodiester linkage and can be incorporated anywhere between two nucleotides in the gNA.

In some embodiments, the disclosure provides a chemically-modified gNA having an end modification comprising a terminal functional group such as an amine, a thiol (or sulfhydryl), a hydroxyl, a carboxyl, carbonyl, thionyl, thiocarbonyl, a carbamoyl, a thiocarbamoyl, a phosphoryl, an alkene, an alkyne, an halogen or a functional group-terminated linker that can be subsequently conjugated to a desired moiety selected from the group consisting of a fluorescent dye, a non-fluorescent label, a tag (for example biotin, avidin, streptavidin, or moiety containing an isotopic label such as $^{15}N$, $^{13}C$, deuterium, $^3H$, $^{32}P$, $^{125}I$ and the like), an oligonucleotide (comprising deoxynucleotides and/or ribonucleotides, including an aptamer), an amino acid, a peptide, a protein, a sugar, an oligosaccharide, a steroid, a lipid, a folic acid, and a vitamin. The conjugation employs standard chemistry well-known in the art, including but not limited to coupling via N-hydroxysuccinimide, isothiocyanate, DCC (or DCI), and/or any other standard method as described in "Bioconjugate Techniques" by Greg T. Hermanson, Publisher Elsevier Science, $3^{rd}$ ed. (2013), the contents of which are incorporated herein by reference in its entirety.

i. Complex Formation with CasX Protein

In some embodiments, a gNA variant has an improved ability to form a complex with a CasX protein (such as a reference CasX or a CasX variant protein) when compared to a reference gRNA. In some embodiments, a gNA variant has an improved affinity for a CasX protein (such as a reference or variant protein) when compared to a reference gRNA, thereby improving its ability to form a ribonucleoprotein (RNP) complex with the CasX protein, as described in the Examples. Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gNA variant and a spacer are competent for gene editing of a target nucleic acid.

Exemplary nucleotide changes that can improve the ability of gNA variants to form a complex with CasX protein may, in some embodiments, include replacing the scaffold stem with a thermostable stem loop. Without wishing to be bound by any theory, replacing the scaffold stem with a thermostable stem loop could increase the overall binding stability of the gNA variant with the CasX protein. Alternatively, or in addition, removing a large section of the stem loop could change the gNA variant folding kinetics and make a functional folded gNA easier and quicker to structurally-assemble, for example by lessening the degree to which the gNA variant can get "tangled" in itself. In some embodiments, choice of scaffold stem loop sequence could change with different spacers that are utilized for the gNA. In some embodiments, scaffold sequence can be tailored to the spacer and therefore the target sequence. Biochemical assays can be used to evaluate the binding affinity of CasX protein for the gNA variant to form the RNP, including the assays of the Examples. For example, a person of ordinary skill can measure changes in the amount of a fluorescently tagged gNA that is bound to an immobilized CasX protein, as a response to increasing concentrations of an additional unlabeled "cold competitor" gNA. Alternatively, or in addition, fluorescence signal can be monitored to or seeing how it changes as different amounts of fluorescently labeled gNA are flowed over immobilized CasX protein. Alternatively, the ability to form an RNP can be assessed using in vitro cleavage assays against a defined target nucleic acid sequence.

j. gNA Stability

In some embodiments, a gNA variant has improved stability when compared to a reference gRNA. Increased stability and efficient folding may, in some embodiments, increase the extent to which a gNA variant persists inside a target cell, which may thereby increase the chance of forming a functional RNP capable of carrying out CasX functions such as gene editing. Increased stability of gNA variants may also, in some embodiments, allow for a similar outcome with a lower amount of gNA delivered to a cell, which may in turn reduce the chance of off-target effects during gene editing.

In other embodiments, the disclosure provides gNA in which the scaffold stem loop and/or the extended stem loop is replaced with a hairpin loop or a thermostable RNA stem loop in which the resulting gNA has increased stability and, depending on the choice of loop, can interact with certain cellular proteins or RNA. In some embodiments, the replacement RNA loop is selected from MS2, Qβ, U1 hairpin II, Uvsx, PP7, Phage replication loop, Kissing loop_a, Kissing loop_b1, Kissing loop_b2, G quadriplex M3q, G quadriplex telomere basket, Sarcin-ricin loop and Pseudoknots. Sequences of gNA variants including such components are provided in Table 2.

Guide NA stability can be assessed in a variety of ways, including for example in vitro by assembling the guide, incubating for varying periods of time in a solution that mimics the intracellular environment, and then measuring functional activity via the in vitro cleavage assays described herein. Alternatively, or in addition, gNAs can be harvested from cells at varying time points after initial transfection/transduction of the gNA to determine how long gNA variants persist relative to reference gRNAs.

k. Solubility

In some embodiments, a gNA variant has improved solubility when compared to a reference gRNA. In some embodiments, a gNA variant has improved solubility of the CasX protein:gNA RNP when compared to a reference gRNA. In some embodiments, solubility of the CasX protein:gNA RNP is improved by the addition of a ribozyme sequence to a 5' or 3' end of the gNA variant, for example the 5' or 3' of a reference sgRNA. Some ribozymes, such as the M1 ribozyme, can increase solubility of proteins through RNA mediated protein folding.

Increased solubility of CasX RNPs comprising a gNA variant as described herein can be evaluated through a variety of means known to one of skill in the art, such as by taking densitometry readings on a gel of the soluble fraction of lysed *E. coli* in which the CasX and gNA variants are expressed.

l. Resistance to Nuclease Activity

In some embodiments, a gNA variant has improved resistance to nuclease activity compared to a reference gRNA. Without wishing to be bound by any theory, increased resistance to nucleases, such as nucleases found in cells, may for example increase the persistence of a variant gNA in an intracellular environment, thereby improving gene editing.

Many nucleases are processive, and degrade RNA in a 3' to 5' fashion. Therefore, in some embodiments the addition of a nuclease resistant secondary structure to one or both termini of the gNA, or nucleotide changes that change the secondary structure of a sgNA, can produce gNA variants with increased resistance to nuclease activity. Resistance to nuclease activity may be evaluated through a variety of methods known to one of skill in the art. For example, in vitro methods of measuring resistance to nuclease activity may include for example contacting reference gNA and variants with one or more exemplary RNA nucleases and measuring degradation. Alternatively, or in addition, measuring persistence of a gNA variant in a cellular environment using the methods described herein can indicate the degree to which the gNA variant is nuclease resistant.

m. Binding Affinity to a Target DNA

In some embodiments, a gNA variant has improved affinity for the target DNA relative to a reference gRNA. In certain embodiments, a ribonucleoprotein complex comprising a gNA variant has improved affinity for the target DNA, relative to the affinity of an RNP comprising a reference gRNA. In some embodiments, the improved affinity of the RNP for the target DNA comprises improved affinity for the target sequence, improved affinity for the PAM sequence, improved ability of the RNP to search DNA for the target sequence, or any combinations thereof. In some embodiments, the improved affinity for the target DNA is the result of increased overall DNA binding affinity.

Without wishing to be bound by theory, it is possible that nucleotide changes in the gNA variant that affect the function of the OBD in the CasX protein may increase the affinity of CasX variant protein binding to the protospacer adjacent motif (PAM), as well as the ability to bind or utilize an increased spectrum of PAM sequences other than the canonical TTC PAM recognized by the reference CasX protein of SEQ ID NO: 2, including PAM sequences selected from the group consisting of TTC, ATC, GTC, and CTC, thereby increasing the affinity and diversity of the CasX variant protein for target DNA sequences, thereby increasing the target nucleic acid sequences that can be edited and/or bound, compared to a reference CasX. As described more fully, below, increasing the sequences of the target nucleic acid that can be edited, compared to a reference CasX, refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target cleavage, or it may be some combination of nucleotides from both strands. In the case of the CasX proteins disclosed herein, the PAM is located 5' of the protospacer with at least a single nucleotide separating the PAM from the first nucleotide of the protospacer. Alternatively, or in addition, changes in the gNA that affect function of the helical I and/or helical II domains that increase the affinity of the CasX variant protein for the target DNA strand can increase the affinity of the CasX RNP comprising the variant gNA for target DNA.

n. Adding or Changing gNA Function

In some embodiments, gNA variants can comprise larger structural changes that change the topology of the gNA variant with respect to the reference gRNA, thereby allowing for different gNA functionality. For example, in some embodiments a gNA variant has swapped an endogenous stem loop of the reference gRNA scaffold with a previously identified stable RNA structure or a stem loop that can interact with a protein or RNA binding partner to recruit additional moieties to the CasX or to recruit CasX to a specific location, such as the inside of a viral capsid, that has the binding partner to the said RNA structure. In other scenarios the RNAs may be recruited to each other, as in Kissing loops, such that two CasX proteins can be co-localized for more effective gene editing at the target DNA sequence. Such RNA structures may include MS2, Qβ, U1 hairpin II, Uvsx, PP7, Phage replication loop, Kissing loop_a, Kissing loop_b1, Kissing loop_b2, G quadriplex M3q, G quadriplex telomere basket, Sarcin-ricin loop, or a Pseudoknot.

In some embodiments, a gNA variant comprises a terminal fusion partner. The term gNA variant is inclusive of variants that include exogenous sequences such as terminal fusions, or internal insertions. Exemplary terminal fusions may include fusion of the gRNA to a self-cleaving ribozyme or protein binding motif. As used herein, a "ribozyme" refers to an RNA or segment thereof with one or more catalytic activities similar to a protein enzyme. Exemplary ribozyme catalytic activities may include, for example, cleavage and/or ligation of RNA, cleavage and/or ligation of DNA, or peptide bond formation. In some embodiments, such fusions could either improve scaffold folding or recruit DNA repair machinery. For example, a gRNA may in some embodiments be fused to a hepatitis delta virus (HDV) antigenomic ribozyme, HDV genomic ribozyme, hatchet ribozyme (from metagenomic data), env25 pistol ribozyme (representative from Aliistipes putredinis), HH15 Minimal Hammerhead ribozyme, tobacco ringspot virus (TRSV) ribozyme, WT viral Hammerhead ribozyme (and rational variants), or Twisted Sister 1 or RBMX recruiting motif. Hammerhead ribozymes are RNA motifs that catalyze reversible cleavage and ligation reactions at a specific site within an RNA molecule. Hammerhead ribozymes include type I, type II and type III hammerhead ribozymes. The HDV, pistol, and hatchet ribozymes have self-cleaving activities. gNA variants comprising one or more ribozymes may allow for expanded gNA function as compared to a gRNA reference. For example, gNAs comprising self-cleaving ribozymes can, in some embodiments, be transcribed and processed into mature gNAs as part of polycistronic transcripts. Such fusions may occur at either the 5' or the 3' end of the gNA. In some embodiments, a gNA variant comprises a fusion at both the 5' and the 3' end, wherein each fusion is independently as described herein. In some embodiments, a gNA variant comprises a phage replication loop or a tetraloop. In some embodiments, a gNA comprises a hairpin loop that is capable of binding a protein. For example, in some embodiments the hairpin loop is an MS2, Qβ, U1 hairpin II, Uvsx, or PP7 hairpin loop.

In some embodiments, a gNA variant comprises one or more RNA aptamers. As used herein, an "RNA aptamer" refers to an RNA molecule that binds a target with high affinity and high specificity.

In some embodiments, a gNA variant comprises one or more riboswitches. As used herein, a "riboswitch" refers to an RNA molecule that changes state upon binding a small molecule.

In some embodiments, the gNA variant further comprises one or more protein binding motifs. Adding protein binding motifs to a reference gRNA or gNA variant of the disclosure may, in some embodiments, allow a CasX RNP to associate with additional proteins, which can for example add the functionality of those proteins to the CasX RNP.

IV. CasX Proteins for Modifying a Target Nucleic Acid

The term "CasX protein", as used herein, refers to a family of proteins, and encompasses all naturally occurring CasX proteins, proteins that share at least 50% identity to naturally occurring CasX proteins, as well as CasX variants possessing one or more improved characteristics relative to a naturally-occurring reference CasX protein. Exemplary improved characteristics of the CasX variant embodiments include, but are not limited to improved folding of the variant, improved binding affinity to the gNA, improved binding affinity to the target nucleic acid, improved ability to utilize a greater spectrum of PAM sequences in the editing and/or binding of target DNA, improved unwinding of the target DNA, increased editing activity, improved editing efficiency, improved editing specificity, increased percentage of a eukaryotic genome that can be efficiently edited, increased activity of the nuclease, increased target strand loading for double strand cleavage, decreased target strand loading for single strand nicking, decreased off-target cleavage, improved binding of the non-target strand of DNA, improved protein stability, improved protein:gNA (RNP) complex stability, improved protein solubility, improved protein:gNA (RNP) complex solubility, improved protein yield, improved protein expression, and improved fusion characteristics, as described more fully, below. In the foregoing embodiments, the one or more of the improved characteristics of the CasX variant is at least about 1.1 to about 100,000-fold improved relative to the reference CasX protein of SEQ ID NO: 1, SEQ ID NO: 2, or SEQ ID NO: 3 when assayed in a comparable fashion. In other embodiments, the improvement is at least about 1.1-fold, at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the reference CasX protein of SEQ ID NO: 1, SEQ ID NO: 2, or SEQ ID NO: 3 when assayed in a comparable fashion.

The term CasX variant is inclusive of variants that are fusion proteins, i.e. the CasX is "fused to" a heterologous sequence. This includes CasX variants comprising CasX variant sequences and N-terminal, C-terminal, or internal fusions of the CasX to a heterologous protein or domain thereof.

CasX proteins of the disclosure comprise at least one of the following domains: a non-target strand binding (NTSB) domain, a target strand loading (TSL) domain, a helical I domain, a helical II domain, an oligonucleotide binding domain (OBD), and a RuvC DNA cleavage domain (the last of which may be modified or deleted in a catalytically dead CasX variant), described more fully, below. Additionally, the CasX variant proteins of the disclosure have an enhanced ability to efficiently edit and/or bind target DNA utilizing PAM sequences selected from TTC, ATC, GTC, or CTC, compared to wild-type reference CasX proteins. In the foregoing, the PAM sequence is located at least 1 nucleotide 5' to the non-target strand of the protospacer having identity with the targeting sequence of the gNA in a assay system compared to the editing efficiency and/or binding of an RNP comprising a reference CasX protein in a comparable assay system.

In some cases, the CasX protein is a naturally-occurring protein (e.g., naturally occurs in and is isolated from prokaryotic cells). In other embodiments, the CasX protein is not a naturally-occurring protein (e.g., the CasX protein is a CasX variant protein, a chimeric protein, and the like). A naturally-occurring CasX protein (referred to herein as a "reference CasX protein") functions as an endonuclease that catalyzes a double strand break at a specific sequence in a targeted double-stranded DNA (dsDNA). The sequence specificity is provided by the targeting sequence of the associated gNA to which it is complexed, which hybridizes to a target sequence within the target nucleic acid.

In some embodiments, a CasX protein can bind and/or modify (e.g., cleave, nick, methylate, demethylate, etc.) a target nucleic acid and/or a polypeptide associated with target nucleic acid (e.g., methylation or acetylation of a histone tail). In some embodiments, the CasX protein is catalytically dead (dCasX) but retains the ability to bind a target nucleic acid. An exemplary catalytically dead CasX protein comprises one or more mutations in the active site of the RuvC domain of the CasX protein. In some embodiments, a catalytically dead CasX protein comprises substitutions at residues 672, 769 and/or 935 of SEQ ID NO: 1. In one embodiment, a catalytically dead CasX protein comprises substitutions of D672A, E769A and/or D935A in a reference CasX protein of SEQ ID NO: 1. In other embodiments, a catalytically dead CasX protein comprises substitutions at amino acids 659, 756 and/or 922 in a reference CasX protein of SEQ ID NO: 2. In some embodiments, a catalytically dead CasX protein comprises D659A, E756A and/or D922A substitutions in a reference CasX protein of SEQ ID NO: 2. In further embodiments, a catalytically dead CasX protein comprises deletions of all or part of the RuvC domain of the CasX protein. It will be understood that the same foregoing substitutions can similarly be introduced into the CasX variants of the disclosure, resulting in a dCasX variant. In one embodiment, all or a portion of the RuvC domain is deleted from the CasX variant, resulting in a dCasX variant. Catalytically inactive dCasX variant proteins can, in some embodiments, be used for base editing or epigenetic modifications. With a higher affinity for DNA, in some embodiments, catalytically inactive dCasX variant proteins can, relative to catalytically active CasX, find their target nucleic acid faster, remain bound to target nucleic acid for longer periods of time, bind target nucleic acid in a more stable fashion, or a combination thereof, thereby improving the function of the catalytically dead CasX variant protein.

a. Non-Target Strand Binding Domain

The reference CasX proteins of the disclosure comprise a non-target strand binding domain (NTSBD). The NTSBD is a domain not previously found in any Cas proteins; for example this domain is not present in Cas proteins such as Cas9, Cas12a/Cpf1, Cas13, Cas14, CASCADE, CSM, or CSY. Without being bound to theory or mechanism, a NTSBD in a CasX allows for binding to the non-target DNA strand and may aid in unwinding of the non-target and target strands. The NTSBD is presumed to be responsible for the unwinding, or the capture, of a non-target DNA strand in the unwound state. The NTSBD is in direct contact with the non-target strand in CryoEM model structures derived to date and may contain a non-canonical zinc finger domain. The NTSBD may also play a role in stabilizing DNA during unwinding, guide RNA invasion and R-loop formation. In some embodiments, an exemplary NTSBD comprises amino acids 101-191 of SEQ ID NO: 1 or amino acids 103-192 of SEQ ID NO: 2. In some embodiments, the NTSBD of a reference CasX protein comprises a four-stranded beta sheet.

b. Target Strand Loading Domain

The reference CasX proteins of the disclosure comprise a Target Strand Loading (TSL) domain. The TSL domain is a domain not found in certain Cas proteins such as Cas9, CASCADE, CSM, or CSY. Without wishing to be bound by theory or mechanism, it is thought that the TSL domain is responsible for aiding the loading of the target DNA strand into the RuvC active site of a CasX protein. In some embodiments, the TSL acts to place or capture the target-strand in a folded state that places the scissile phosphate of the target strand DNA backbone in the RuvC active site. The TSL comprises a cys4 (CXXC (SEQ ID NO: 246, CXXC (SEQ ID NO: 246) zinc finger/ribbon domain that is separated by the bulk of the TSL. In some embodiments, an exemplary TSL comprises amino acids 825-934 of SEQ ID NO: 1 or amino acids 813-921 of SEQ ID NO: 2.

c. Helical I Domain

The reference CasX proteins of the disclosure comprise a helical I domain. Certain Cas proteins other than CasX have domains that may be named in a similar way. However, in some embodiments, the helical I domain of a CasX protein comprises one or more unique structural features, or comprises a unique sequence, or a combination thereof, compared to non-CasX proteins. For example, in some embodiments, the helical I domain of a CasX protein comprises one or more unique secondary structures compared to domains in other Cas proteins that may have a similar name. For example, in some embodiments the helical I domain in a CasX protein comprises one or more alpha helices of unique structure and sequence in arrangement, number and length compared to other CRISPR proteins. In certain embodiments, the helical I domain is responsible for interacting with the bound DNA and spacer of the guide RNA. Without wishing to be bound by theory, it is thought that in some cases the helical I domain may contribute to binding of the protospacer adjacent motif (PAM). In some embodiments, an exemplary helical I domain comprises amino acids 57-100 and 192-332 of SEQ ID NO: 1, or amino acids 59-102 and 193-333 of SEQ ID NO: 2. In some embodiments, the helical I domain of a reference CasX protein comprises one or more alpha helices.

d. Helical II Domain

The reference CasX proteins of the disclosure comprise a helical II domain. Certain Cas proteins other than CasX have domains that may be named in a similar way. However, in some embodiments, the helical II domain of a CasX protein comprises one or more unique structural features, or a unique sequence, or a combination thereof, compared to domains in other Cas proteins that may have a similar name. For example, in some embodiments, the helical II domain comprises one or more unique structural alpha helical bundles that align along the target DNA:guide RNA channel. In some embodiments, in a CasX comprising a helical II domain, the target strand and guide RNA interact with helical II (and the helical I domain, in some embodiments) to allow RuvC domain access to the target DNA. The helical II domain is responsible for binding to the guide RNA scaffold stem loop as well as the bound DNA. In some embodiments, an exemplary helical II domain comprises amino acids 333-509 of SEQ ID NO: 1, or amino acids 334-501 of SEQ ID NO: 2.

e. Oligonucleotide Binding Domain

The reference CasX proteins of the disclosure comprise an Oligonucleotide Binding Domain (OBD). Certain Cas proteins other than CasX have domains that may be named in a similar way. However, in some embodiments, the OBD comprises one or more unique functional features, or comprises a sequence unique to a CasX protein, or a combination thereof. For example, in some embodiments the bridged helix (BH), helical I domain, helical II domain, and Oligonucleotide Binding Domain (OBD) together are responsible for binding of a CasX protein to the guide RNA. Thus, for example, in some embodiments the OBD is unique to a CasX protein in that it interacts functionally with a helical I domain, or a helical II domain, or both, each of which may be unique to a CasX protein as described herein. Specifically, in CasX the OBD largely binds the RNA triplex of the guide RNA scaffold. The OBD may also be responsible for binding to the protospacer adjacent motif (PAM). An exemplary OBD domain comprises amino acids 1-56 and 510-660 of SEQ ID NO: 1, or amino acids 1-58 and 502-647 of SEQ ID NO: 2.

f. RuvC DNA Cleavage Domain

The reference CasX proteins of the disclosure comprise a RuvC domain, that includes 2 partial RuvC domains (RuvC-I and RuvC-II). The RuvC domain is the ancestral domain of all type 12 CRISPR proteins. The RuvC domain originates from a TNPB (transposase B) like transposase. Similar to other RuvC domains, the CasX RuvC domain has a DED catalytic triad that is responsible for coordinating a magnesium (Mg) ion and cleaving DNA. In some embodiments, the RuvC has a DED motif active site that is responsible for cleaving both strands of DNA (one by one, most likely the non-target strand first at 11-14 nucleotides (nt) into the targeted sequence and then the target strand next at 2-4 nucleotides after the target sequence). Specifically in CasX, the RuvC domain is unique in that it is also responsible for binding the guide RNA scaffold stem loop that is critical for CasX function. An exemplary RuvC domain comprises amino acids 661-824 and 935-986 of SEQ ID NO: 1, or amino acids 648-812 and 922-978 of SEQ ID NO: 2.

g. Reference CasX Proteins

The disclosure provides reference CasX proteins. In some embodiments, a reference CasX protein is a naturally-occurring protein. For example, reference CasX proteins can be isolated from naturally occurring prokaryotes, such as Deltaproteobacteria, Planctomycetes, or *Candidatus* Sungbacteria species. A reference CasX protein (sometimes referred to herein as a reference CasX polypeptide) is a type II CRISPR/Cas endonuclease belonging to the CasX (sometimes referred to as Cas12e) family of proteins that is capable of interacting with a guide NA to form a ribonucleoprotein (RNP) complex. In some embodiments, the RNP complex comprising the reference CasX protein can be targeted to a particular site in a target nucleic acid via base pairing between the targeting sequence (or spacer) of the gNA and a target sequence in the target nucleic acid. In some embodiments, the RNP comprising the reference CasX protein is capable of cleaving target DNA. In some embodiments, the RNP comprising the reference CasX protein is capable of nicking target DNA. In some embodiments, the RNP comprising the reference CasX protein is capable of editing target DNA, for example in those embodiments where the reference CasX protein is capable of cleaving or nicking DNA, followed by non-homologous end joining (NHEJ), homology-directed repair (HDR), homology-independent targeted integration (HITI), micro-homology mediated end joining (MMEJ), single strand annealing (SSA) or base excision repair (BER). In some embodiments, the RNP comprising the CasX protein is a catalytically dead (is catalytically inactive or has substantially no cleavage activity) CasX protein (dCasX), but retains the ability to bind the target DNA, described more fully, supra.

In some cases, a reference CasX protein is isolated or derived from Deltaproteobacteria. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of

```
                                                                  (SEQ ID NO: 1)
  1 MEKRINKIRK KLSADNATKP VSRSGPMKTL LVRVMTDDLK KRLEKRRKKP EVMPQVISNN

61 AANNLRMLLD DYTKMKEAIL QVYWQEFKDD HVGLMCKFAQ PASKKIDQNK LKPEMDEKGN

121 LTTAGFACSQ CGQPLFVYKL EQVSEKGKAY TNYFGRCNVA EHEKLILLAQ LKPEKDSDEA

181 VTYSLGKFGQ RALDFYSIHV TKESTHPVKP LAQIAGNRYA SGPVGKALSD ACMGTIASFL

241 SKYQDIIIEH QKVVKGNQKR LESLRELAGK ENLEYPSVTL PPQPHTKEGV DAYNEVIARV

301 RMWVNLNLWQ KLKLSRDDAK PLLRLKGFPS FPVVERRENE VDWWNTINEV KKLIDAKRDM

361 GRVFWSGVTA EKRNTILEGY NYLPNENDHK KREGSLENPK KPAKRQFGDL LLYLEKKYAG

421 DWGKVFDEAW ERIDKKIAGL TSHIEREEAR NAEDAQSKAV LTDWLRAKAS FVLERLKEMD

481 EKEFYACEIQ LQKWYGDLRG NPFAVEAENR VVDISGFSIG SDGHSIQYRN LLAWKYLENG

541 KREFYLLMNY GKKGRIRFTD GTDIKKSGKW QGLLYGGGKA KVIDLTFDPD DEQLIILPLA

601 FGTRQGREFI WNDLLSLETG LIKLANGRVI EKTIYNKKIG RDEPALFVAL TFERREVVDP

661 SNIKPVNLIG VDRGENIPAV IALTDPEGCP LPEFKDSSGG PTDILRIGEG YKEKQRAIQA

721 AKEVEQRRAG GYSRKFASKS RNLADDMVRN SARDLFYHAV THDAVLVFEN LSRGFGRQGK

781 RTFMTERQYT KMEDWLTAKL AYEGLTSKTY LSKTLAQYTS KTCSNCGFTI TTADYDGMLV

841 RLKKTSDGWA TTLNNKELKA EGQITYYNRY KRQTVEKELS AELDRLSEES GNNDISKWTK

901 GRRDEALFLL KKRFSHRPVQ EQFVCLDCGH EVHADEQAAL NIARSWLFLN SNSTEFKSYK

961 SGKQPFVGAW QAFYKRRLKE VWKPNA.
```

In some cases, a reference CasX protein is isolated or derived from Planctomycetes. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

the sequence of SEQ ID NO: 2. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO: 2. These mutations can be insertions, deletions, amino acid substitutions, or any combinations thereof.

In some cases, a reference CasX protein is isolated or derived from *Candidatus* Sungbacteria. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85%

```
                                                                    (SEQ ID NO: 2)
  1  MQEIKRINKI  RRRLVKDSNT  KKAGKTGPMK  TLLVRVMTPD  LRERLENLRK  KPENIPQPIS

61  NTSRANLNKL  LTDYTEMKKA  ILHVYWEEFO  KDPVGLMSRV  AOPAPHNIDO  RKLIPVKDGN

121  ERLTSSGFAC  SQCCQPLYVY  KLEQVNDKGK  PHTNYFGRCN  VSEHEPLILL  SPHKPEANDE

181  LVTYSLGKFG  QRALDFYSIH  VTPESNHPVK  PLEQIGGNSC  ASGPVGKALS  DACMGAVASF

241  LTKYODIILE  HQKVIKKNEK  RLANLKDIAS  ANGLAFPKIT  LPPQPHTKEG  IEAYNNVVAQ

301  IVIWVNLNLW  QKLKIGRDEA  KPLQRLKGFP  SFPLVERQAN  EVDWWDMVCN  VKKLINEKKE

361  DGKVFWQNLA  GYKRQEALLP  YLSSEEDRKK  GNKFARYQFG  DLLLHLEKKH  GEDWGKVYDE

421  AWERIDKKVE  GLSKHIKLEE  ERRSEDAQSK  AALTDWLPAK  ASFVIEGLKE  ADKDEFCRCE

481  LKLQKWYGDL  PGKPFAIEAE  NSILDISGFS  KQYNCAFIWQ  KDGVKKLNLY  LIINYFKGGK

541  LRFKKIKPEA  FEANRFYTVI  NKKSGEIVPM  EVNFNFDDPN  LIILPLAFGK  RQGREFIWND

601  LLSLETGSLK  LANGRVIEKT  LYNRRTRQDE  RALFVALTFE  RREVLDSSNI  KPMNLIGIDR

661  GENIPAVIAL  TDPEGCPLSR  FKDSLGNPTH  ILRIGESYKE  KQRTIQAAKE  VEQRPAGGYS

721  RKYASKAKNL  ADEMVRNTAR  DLLYYAVTQD  AMLIFENLSR  GEGRQGKRTF  MAERQYTRME

781  DWLTAKLAYE  GLPSKTYLSK  TLATZTSKTC  SNCGFTITSA  DYDRVLEKLK  KTATGWMTTI

841  NGKELKVEGQ  ITYYNPYKRQ  NVVKDLSVEL  DRLSEESVNN  DISSWTKGRS  GEALSLLKKR

901  FSHRPVQEKF  VCLNCGFETH  ADEQAALNIA  RSWLFIRSQE  YKKYQTNKTT  GNTDKRAFVE

961  TWQSFYRKKL  KEVWKPAV.
```

In some embodiments, the CasX protein comprises the sequence of SEQ ID NO: 2, or at least 60% similarity thereto. In some embodiments, the CasX protein comprises the sequence of SEQ ID NO: 2, or at least 80% similarity thereto. In some embodiments, the CasX protein comprises the sequence of SEQ ID NO: 2, or at least 90% similarity thereto. In some embodiments, the CasX protein comprises the sequence of SEQ ID NO: 2, or at least 95% similarity thereto. In some embodiments, the CasX protein consists of identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of

```
                                                                    (SEQ ID NO: 3)
  1  MDNANKPSTK  SLVNTTRISD  HFGVTPGQVT  RVFSFGIIPT  KRQYAIIERW  FAAVEAARER

61  LYGMIYARFQ  ENPPAYIKEK  FSYETFFKGR  PVLNGLRDID  PTIMTSAVFT  ALRHKAEGAM

121  AAFHTNERRL  FEEARKKMRE  YAECLKANEA  LURGAAD1DW  DKIVNALRTR  LNTCLAPEYD

181  AVIADFGALC  AFRALIAETN  ALKGAYNHAL  NQMLPALVKV  DEPEEAEESP  RLRFFNGRIN

241  DLPHFPVAER  ETPPDTETII  RQLEDMARVI  PDTAEILGYI  HRIRHKAARR  KPGSAVPLPQ

301  RVALYCAIRM  ERNPEEDPST  VAGHFLGEID  RVCEKPRQGL  VPTPFDSQIR  ARYMDIISFR
```

```
361 ATLAHPDRWT EIQFLRSNAA SRRVRAETIS APFEGFSWTS NRTNPAPQYG MALAKDANAP

421 ADAPELCICL SPSSAAFSVR EKGGDLIYMR PTGGRRGKDN PGKEITWVPG SFDEYPASGV

481 ALKLRLYFGR SQARRMLTNN TWGLLSDNPR VFAANAELVG KKRNPQDRWK LFFHMVISGP

541 PPVEYLDFSS DVRSRARTVI GINRGEVNPL AYAVVSVEDG QVLEEGLLGK KEYIDQLIET

601 RRPISEYQSR EQTPPRDLRQ RVPHLQDTVL GSARAKIHSL IAFWKGILAI ERLDDQFHGR

661 EQKIIPKKTY LANKTGFMNA LSFSGAVRVD KEGNPWGGMI ETYPGGISRT CTQCGTVWLA

721 RRPKNPGHRD ANVVIPDIVD DAAATGFDNV DCDAGTVDYG ELFTLSREWV RLTPPYSRVM

781 RGTLGDLEPA IRQGDDRKSR QMLELALEPQ PQWGQFECHR CGFNGQSDVL AATNLARRAI

841 SLIRRLPDTD TPPTP.
```

In some embodiments, the CasX protein comprises the sequence of SEQ ID NO: 3, or at least 60% similarity thereto. In some embodiments, the CasX protein comprises the sequence of SEQ ID NO: 3, or at least 80% similarity thereto. In some embodiments, the CasX protein comprises the sequence of SEQ ID NO: 3, or at least 90% similarity thereto. In some embodiments, the CasX protein comprises the sequence of SEQ ID NO: 3, or at least 95% similarity thereto. In some embodiments, the CasX protein consists of the sequence of SEQ ID NO: 3. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO: 3. These mutations can be insertions, deletions, amino acid substitutions, or any combinations thereof.

h. CasX Variant Proteins

The present disclosure provides variants of a reference CasX protein (interchangeably referred to herein as "CasX variant" or "CasX variant protein"), wherein the CasX variants comprise at least one modification in at least one domain relative to the reference CasX protein, including but not limited to the sequences of SEQ ID NOS:1-3. In some embodiments, the CasX variant exhibits at least one improved characteristic compared to the reference CasX protein. All variants that improve one or more functions or characteristics of the CasX variant protein when compared to a reference CasX protein described herein are envisaged as being within the scope of the disclosure. In some embodiments, the modification is a mutation in one or more amino acids of the reference CasX. In other embodiments, the modification is a substitution of one or more domains of the reference CasX with one or more domains from a different CasX. In some embodiments, insertion includes the insertion of a part or all of a domain from a different CasX protein. Mutations can occur in any one or more domains of the reference CasX protein, and may include, for example, deletion of part or all of one or more domains, or one or more amino acid substitutions, deletions, or insertions in any domain of the reference CasX protein. The domains of CasX proteins include the non-target strand binding (NTSB) domain, the target strand loading (TSL) domain, the helical I domain, the helical II domain, the oligonucleotide binding domain (OBD), and the RuvC DNA cleavage domain. Any change in amino acid sequence of a reference CasX protein that leads to an improved characteristic of the CasX protein is considered a CasX variant protein of the disclosure. For example, CasX variants can comprise one or more amino acid substitutions, insertions, deletions, or swapped domains, or any combinations thereof, relative to a reference CasX protein sequence.

In some embodiments, the CasX variant protein comprises at least one modification in at least each of two domains of the reference CasX protein, including the sequences of SEQ ID NOS: 1-3. In some embodiments, the CasX variant protein comprises at least one modification in at least 2 domains, in at least 3 domains, at least 4 domains or at least 5 domains of the reference CasX protein. In some embodiments, the CasX variant protein comprises two or more modifications in at least one domain of the reference CasX protein. In some embodiments, the CasX variant protein comprises at least two modifications in at least one domain of the reference CasX protein, at least three modifications in at least one domain of the reference CasX protein or at least four modifications in at least one domain of the reference CasX protein. In some embodiments, wherein the CasX variant comprises two or more modifications compared to a reference CasX protein, each modification is made in a domain independently selected from the group consisting of a NTSBD, TSLD, helical I domain, helical II domain, OBD, and RuvC DNA cleavage domain.

In some embodiments, the at least one modification of the CasX variant protein comprises a deletion of at least a portion of one domain of the reference CasX protein. In some embodiments, the deletion is in the NTSBD, TSLD, helical I domain, helical II domain, OBD, or RuvC DNA cleavage domain.

Suitable mutagenesis methods for generating CasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping. Exemplary methods for the generation of CasX variants with improved characteristics are provided in the Examples, below. In some embodiments, the CasX variants are designed, for example by selecting one or more desired mutations in a reference CasX. In certain embodiments, the activity of a reference CasX protein is used as a benchmark against which the activity of one or more CasX variants are compared, thereby measuring improvements in function of the CasX variants. Exemplary improvements of CasX variants include, but are not limited to, improved folding of the variant, improved binding affinity to the gNA, improved binding affinity to the target DNA, improved ability to utilize a greater spectrum of PAM sequences in the editing or binding of target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved CasX:gNA (RNP) complex stability, improved protein solubility, improved CasX:gNA (RNP) complex solubility, improved protein yield, improved protein expression, and improved fusion characteristics, as described more fully, below.

In some embodiments of the CasX variants described herein, the at least one modification comprises: (a) a substitution of 1 to 100 consecutive or non-consecutive amino acids in the CasX variant; (b) a deletion of 1 to 100 consecutive or non-consecutive amino acids in the CasX variant; (c) an insertion of 1 to 100 consecutive or non-consecutive amino acids in the CasX; or (d) any combination of (a)-(c). In some embodiments, the at least one modification comprises: (a) a substitution of 5-10 consecutive or non-consecutive amino acids in the CasX variant; (b) a deletion of 1-5 consecutive or non-consecutive amino acids in the CasX variant; (c) an insertion of 1-5 consecutive or non-consecutive amino acids in the CasX; or (d) any combination of (a)-(c).

In some embodiments, the CasX variant protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO: 1, SEQ ID NO: 2, or SEQ ID NO: 3. These mutations can be insertions, deletions, amino acid substitutions, or any combinations thereof.

In some embodiments, the CasX variant protein comprises at least one amino acid substitution in at least one domain of a reference CasX protein. In some embodiments, the CasX variant protein comprises at least about 1-4 amino acid substitutions, 1-10 amino acid substitutions, 1-20 amino acid substitutions, 1-30 amino acid substitutions, 1-40 amino acid substitutions, 1-50 amino acid substitutions, 1-60 amino acid substitutions, 1-70 amino acid substitutions, 1-80 amino acid substitutions, 1-90 amino acid substitutions, 1-100 amino acid substitutions, 2-10 amino acid substitutions, 2-20 amino acid substitutions, 2-30 amino acid substitutions, 3-10 amino acid substitutions, 3-20 amino acid substitutions, 3-30 amino acid substitutions, 4-10 amino acid substitutions, 4-20 amino acid substitutions, 3-300 amino acid substitutions, 5-10 amino acid substitutions, 5-20 amino acid substitutions, 5-30 amino acid substitutions, 10-50 amino acid substitutions, or 20-50 amino acid substitutions, relative to a reference CasX protein. In some embodiments, the CasX variant protein comprises at least about 100 amino acid substitutions relative to a reference CasX protein. In some embodiments, the CasX variant protein comprises 1, 2, 3, 4, 5, 6, 7, 8, 9 or 10 amino acid substitutions relative to a reference CasX protein. In some embodiments, the CasX variant protein comprises 1, 2, 3, 4, 5, 6, 7, 8, 9 or 10 amino acid substitutions in a single domain relative to the reference CasX protein. In some embodiments, the amino acid substitutions are conservative substitutions. In other embodiments, the substitutions are non-conservative; e.g., a polar amino acid is substituted for a non-polar amino acid, or vice versa.

In some embodiments, a CasX variant protein comprises 1 amino acid substitution, 2-3 consecutive amino acid substitutions, 2-4 consecutive amino acid substitutions, 2-5 consecutive amino acid substitutions, 2-6 consecutive amino acid substitutions, 2-7 consecutive amino acid substitutions, 2-8 consecutive amino acid substitutions, 2-9 consecutive amino acid substitutions, 2-10 consecutive amino acid substitutions, 2-20 consecutive amino acid substitutions, 2-30 consecutive amino acid substitutions, 2-40 consecutive amino acid substitutions, 2-50 consecutive amino acid substitutions, 2-60 consecutive amino acid substitutions, 2-70 consecutive amino acid substitutions, 2-80 consecutive amino acid substitutions, 2-90 consecutive amino acid substitutions, 2-100 consecutive amino acid substitutions, 3-10 consecutive amino acid substitutions, 3-20 consecutive amino acid substitutions, 3-30 consecutive amino acid substitutions, 4-10 consecutive amino acid substitutions, 4-20 consecutive amino acid substitutions, 3-300 consecutive amino acid substitutions, 5-10 consecutive amino acid substitutions, 5-20 consecutive amino acid substitutions, 5-30 consecutive amino acid substitutions, 10-50 consecutive amino acid substitutions or 20-50 consecutive amino acid substitutions relative to a reference CasX protein. In some embodiments, a CasX variant protein comprises 2, 3, 4, 5, 6, 7, 8, 9, 10, 11, 12, 13, 14, 15, 16, 17, 18, 19 or 20 consecutive amino acid substitutions. In some embodiments, a CasX variant protein comprises a substitution of at least about 100 consecutive amino acids. As used herein "consecutive amino acids" refer to amino acids that are contiguous in the primary sequence of a polypeptide.

In some embodiments, a CasX variant protein comprises two or more substitutions relative to a reference CasX protein, and the two or more substitutions are not in consecutive amino acids of the reference CasX sequence. For example, a first substitution may be in a first domain of the reference CasX protein, and a second substitution may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive substitutions relative to a reference CasX protein. In some embodiments, a CasX variant protein comprises at least 20 non-consecutive substitutions relative to a reference CasX protein. Each non-consecutive substitution may be of any length of amino acids described herein, e.g., 1-4 amino acids, 1-10 amino acids, and the like. In some embodiments, the two or more substitutions relative to the reference CasX protein are not the same length, for example, one substitution is one amino acid and a second substitution is three amino acids. In some embodiments, the two or more substitutions relative to the reference CasX protein are the same length, for example both substitutions are two consecutive amino acids in length.

Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference CasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a CasX variant protein of the disclosure.

In some embodiments, a CasX variant protein comprises at least one amino acid deletion relative to a reference CasX protein. In some embodiments, a CasX variant protein comprises a deletion of 1-4 amino acids, 1-10 amino acids, 1-20 amino acids, 1-30 amino acids, 1-40 amino acids, 1-50 amino acids, 1-60 amino acids, 1-70 amino acids, 1-80 amino acids, 1-90 amino acids, 1-100 amino acids, 2-10 amino acids, 2-20 amino acids, 2-30 amino acids, 3-10 amino acids, 3-20 amino acids, 3-30 amino acids, 4-10 amino acids, 4-20 amino acids, 3-300 amino acids, 5-10 amino acids, 5-20 amino acids, 5-30 amino acids, 10-50 amino acids or 20-50 amino acids relative to a reference CasX protein. In some embodiments, a CasX variant comprises a deletion of at least about 100 consecutive amino acids relative to a reference CasX protein. In some embodiments, a CasX variant protein comprises a deletion of at least 1, 2, 3, 4, 5, 6, 7, 8, 9, 10, 20, 30, 40, 50 or 100 consecutive amino acids relative to a reference CasX protein. In some embodiments, a CasX variant protein comprises a deletion of 1, 2, 3, 4, 5, 6, 7, 8, 9 or 10 consecutive amino acids.

In some embodiments, a CasX variant protein comprises two or more deletions relative to a reference CasX protein, and the two or more deletions are not consecutive amino acids. For example, a first deletion may be in a first domain of the reference CasX protein, and a second deletion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive deletions relative to a reference CasX protein. In some embodiments, a CasX variant protein comprises at least 20 non-consecutive deletions relative to a reference CasX protein. Each non-consecutive deletion may be of any length of amino acids described herein, e.g., 1-4 amino acids, 1-10 amino acids, and the like.

In some embodiments, the CasX variant protein comprises at least one amino acid insertion. In some embodiments, a CasX variant protein comprises an insertion of 1 amino acid, an insertion of 2-3 consecutive amino acids, 2-4 consecutive amino acids, 2-5 consecutive amino acids, 2-6 consecutive amino acids, 2-7 consecutive amino acids, 2-8 consecutive amino acids, 2-9 consecutive amino acids, 2-10 consecutive amino acids, 2-20 consecutive amino acids, 2-30 consecutive amino acids, 2-40 consecutive amino acids, 2-50 consecutive amino acids, 2-60 consecutive amino acids, 2-70 consecutive amino acids, 2-80 consecutive amino acids, 2-90 consecutive amino acids, 2-100 consecutive amino acids, 3-10 consecutive amino acids, 3-20 consecutive amino acids, 3-30 consecutive amino acids, 4-10 consecutive amino acids, 4-20 consecutive amino acids, 3-300 consecutive amino acids, 5-10 consecutive amino acids, 5-20 consecutive amino acids, 5-30 consecutive amino acids, 10-50 consecutive amino acids or 20-50 consecutive amino acids relative to a reference CasX protein. In some embodiments, the CasX variant protein comprises an insertion of 2, 3, 4, 5, 6, 7, 8, 9, 10, 11, 12, 13, 14, 15, 16, 17, 18, 19 or 20 consecutive amino acids. In some embodiments, a CasX variant protein comprises an insertion of at least about 100 consecutive amino acids.

In some embodiments, a CasX variant protein comprises two or more insertions relative to a reference CasX protein, and the two or more insertions are not consecutive amino acids of the sequence. For example, a first insertion may be in a first domain of the reference CasX protein, and a second insertion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive insertions relative to a reference CasX protein. In some embodiments, a CasX variant protein comprises at least 10 to about 20 or more non-consecutive insertions relative to a reference CasX protein. Each non-consecutive insertion may be of any length of amino acids described herein, e.g., 1-4 amino acids, 1-10 amino acids, and the like.

Any amino acid, or combination of amino acids, can be inserted as described herein. For example, a proline, argi- nine, histidine, lysine, aspartic acid, glutamic acid, serine, threonine, asparagine, glutamine, cysteine, glycine, alanine, isoleucine, leucine, methionine, phenylalanine, tryptophan, tyrosine or valine or any combination thereof can be inserted into a reference CasX protein of the disclosure to generate a CasX variant protein.

Any permutation of the substitution, insertion and deletion embodiments described herein can be combined to generate a CasX variant protein of the disclosure. For example, a CasX variant protein can comprise at least one substitution and at least one deletion relative to a reference CasX protein sequence, at least one substitution and at least one insertion relative to a reference CasX protein sequence, at least one insertion and at least one deletion relative to a reference CasX protein sequence, or at least one substitution, one insertion and one deletion relative to a reference CasX protein sequence.

In some embodiments, the CasX variant protein has at least about 60% sequence similarity, at least 70% similarity, at least 80% similarity, at least 85% similarity, at least 86% similarity, at least 87% similarity, at least 88% similarity, at least 89% similarity, at least 90% similarity, at least 91% similarity, at least 92% similarity, at least 93% similarity, at least 94% similarity, at least 95% similarity, at least 96% similarity, at least 97% similarity, at least 98% similarity, at least 99% similarity, at least 99.5% similarity, at least 99.6% similarity, at least 99.7% similarity, at least 99.8% similarity or at least 99.9% similarity to one of SEQ ID NO: 1, SEQ ID NO: 2, or SEQ ID NO: 3.

In some embodiments, the CasX variant protein has at least about 60% sequence similarity to SEQ ID NO: 2 or a portion thereof. In some embodiments, the CasX variant protein comprises a substitution of Y789T of SEQ ID NO: 2, a deletion of P793 of SEQ ID NO: 2, a substitution of Y789D of SEQ ID NO: 2, a substitution of T72S of SEQ ID NO: 2, a substitution of I546V of SEQ ID NO: 2, a substitution of E552A of SEQ ID NO: 2, a substitution of A636D of SEQ ID NO: 2, a substitution of F536S of SEQ ID NO:2, a substitution of A708K of SEQ ID NO: 2, a substitution of Y797L of SEQ ID NO: 2, a substitution of L792G SEQ ID NO: 2, a substitution of A739V of SEQ ID NO: 2, a substitution of G791M of SEQ ID NO: 2, an insertion of A at position 661 of SEQ ID NO: 2, a substitution of A788W of SEQ ID NO: 2, a substitution of K390R of SEQ ID NO: 2, a substitution of A751S of SEQ ID NO: 2, a substitution of E385A of SEQ ID NO: 2, an insertion of P at position 696 of SEQ ID NO: 2, an insertion of M at position 773 of SEQ ID NO: 2, a substitution of G695H of SEQ ID NO: 2, an insertion of AS at position 793 of SEQ ID NO: 2, an insertion of AS at position 795 of SEQ ID NO: 2, a substitution of C477R of SEQ ID NO: 2, a substitution of C477K of SEQ ID NO: 2, a substitution of C479A of SEQ ID NO: 2, a substitution of C479L of SEQ ID NO: 2, a substitution of I55F of SEQ ID NO: 2, a substitution of K210R of SEQ ID NO: 2, a substitution of C233S of SEQ ID NO: 2, a substitution of D231N of SEQ ID NO: 2, a substitution of Q338E of SEQ ID NO: 2, a substitution of Q338R of SEQ ID NO: 2, a substitution of L379R of SEQ ID NO: 2, a substitution of K390R of SEQ ID NO: 2, a substitution of L481Q of SEQ ID NO: 2, a substitution of F495S of SEQ ID NO:2, a substitution of D600N of SEQ ID NO: 2, a substitution of T886K of SEQ ID NO: 2, a substitution of A739V of SEQ ID NO: 2, a substitution of K460N of SEQ ID NO: 2, a substitution of I199F of SEQ ID NO: 2, a substitution of G492P of SEQ ID NO: 2, a substitution of T153I of SEQ ID NO: 2, a substitution of R591I of SEQ ID NO: 2, an insertion of AS at position 795 of SEQ ID NO: 2, an insertion of AS at position 796 of SEQ ID NO:2, an insertion of L at position 889 of SEQ ID NO: 2, a substitution of E121D of SEQ ID NO: 2, a substitution of S270W of SEQ ID NO: 2, a substitution of E712Q of SEQ ID NO: 2, a substitution of K942Q of SEQ ID NO: 2, a substitution of E552K of SEQ ID NO:2, a substitution of K25Q of SEQ ID NO: 2, a substitution of N47D of SEQ ID NO: 2, an insertion of T at position 696 of SEQ ID NO: 2, a substitution of L685I of SEQ ID NO: 2, a substitution of N880D of SEQ ID NO: 2, a substitution of Q102R of SEQ ID NO: 2, a substitution of M734K of SEQ ID NO: 2, a substitution of A724S of SEQ ID NO: 2, a substitution of T704K of SEQ ID NO: 2, a substitution of P224K of SEQ ID NO: 2, a substitution of K25R of SEQ ID NO: 2, a substitution of M29E of SEQ ID NO: 2, a substitution of H152D of SEQ ID NO: 2, a substitution of S219R of SEQ ID NO: 2, a substitution of E475K of SEQ ID NO: 2, a substitution of G226R of SEQ ID NO: 2, a substitution of A377K of SEQ ID NO: 2, a substitution of E480K of SEQ ID NO: 2, a substitution of K416E of SEQ ID NO: 2, a substitution of H164R of SEQ ID NO: 2, a substitution of K767R of SEQ ID NO: 2, a substitution of I7F of SEQ ID NO: 2, a substitution of M29R of SEQ ID NO: 2, a substitution of H435R of SEQ ID NO: 2, a substitution of E385Q of SEQ ID NO: 2, a substitution of E385K of SEQ ID NO: 2, a substitution of I279F of SEQ ID NO: 2, a substitution of D489S of SEQ ID NO: 2, a substitution of D732N of SEQ ID NO: 2, a substitution of A739T of SEQ ID NO: 2, a substitution of W885R of SEQ ID NO: 2, a substitution of E53K of SEQ ID NO: 2, a substitution of A238T of SEQ ID NO: 2, a substitution of P283Q of SEQ ID NO: 2, a substitution of E292K of SEQ ID NO: 2, a substitution of Q628E of SEQ ID NO: 2, a substitution of R388Q of SEQ ID NO: 2, a substitution of G791M of SEQ ID NO: 2, a substitution of L792K of SEQ ID NO: 2, a substitution of L792E of SEQ ID NO: 2, a substitution of M779N of SEQ ID NO: 2, a substitution of G27D of SEQ ID NO: 2, a substitution of K955R of SEQ ID NO: 2, a substitution of S867R of SEQ ID NO: 2, a substitution of R693I of SEQ ID NO: 2, a substitution of F189Y of SEQ ID NO: 2, a substitution of V635M of SEQ ID NO: 2, a substitution of F399L of SEQ ID NO: 2, a substitution of E498K of SEQ ID NO: 2, a substitution of E386R of SEQ ID NO: 2, a substitution of V254G of SEQ ID NO: 2, a substitution of P793S of SEQ ID NO: 2, a substitution of K188E of SEQ ID NO: 2, a substitution of QT945KI of SEQ ID NO: 2, a substitution of T620P of SEQ ID NO: 2, a substitution of T946P of SEQ ID NO: 2, a substitution of TT949PP of SEQ ID NO: 2, a substitution of N952T of SEQ ID NO: 2, a substitution of K682E of SEQ ID NO: 2, a substitution of K975R of SEQ ID NO: 2, a substitution of L212P of SEQ ID NO: 2, a substitution of E292R of SEQ ID NO: 2, a substitution of I303K of SEQ ID NO: 2, a substitution of C349E of SEQ ID NO: 2, a substitution of E385P of SEQ ID NO: 2, a substitution of E386N of SEQ ID NO: 2, a substitution of D387K of SEQ ID NO: 2, a substitution of L404K of SEQ ID NO: 2, a substitution of E466H of SEQ ID NO: 2, a substitution of C477Q of SEQ ID NO: 2, a substitution of C477H of SEQ ID NO: 2, a substitution of C479A of SEQ ID NO: 2, a substitution of D659H of SEQ ID NO: 2, a substitution of T806V of SEQ ID NO: 2, a substitution of K808S of SEQ ID NO: 2, an insertion of AS at position 797 of SEQ ID NO: 2, a substitution of V959M of SEQ ID NO: 2, a substitution of K975Q of SEQ ID NO: 2, a substitution of W974G of SEQ ID NO: 2, a substitution of A708Q of SEQ ID NO: 2, a substitution of V711K of SEQ ID NO: 2, a substitution of D733T of SEQ ID NO: 2, a substitution of L742W of SEQ ID NO: 2, a substitution of V747K of SEQ ID NO: 2, a substitution of F755M of SEQ ID NO: 2, a substitution of M771A of SEQ ID NO: 2, a substitution of M771Q of SEQ ID NO: 2, a substitution of W782Q of SEQ ID NO: 2, a substitution of G791F, of SEQ ID NO: 2 a substitution of L792D of SEQ ID NO: 2, a substitution of L792K of SEQ ID NO: 2, a substitution of P793Q of SEQ ID NO: 2, a substitution of P793G of SEQ ID NO: 2, a substitution of Q804A of SEQ ID NO: 2, a substitution of Y966N of SEQ ID NO: 2, a substitution of Y723N of SEQ ID NO: 2, a substitution of Y857R of SEQ ID NO: 2, a substitution of S890R of SEQ ID NO: 2, a substitution of S932M of SEQ ID NO: 2, a substitution of L897M of SEQ ID NO: 2, a substitution of R624G of SEQ ID NO: 2, a substitution of S603G of SEQ ID NO: 2, a substitution of N737S of SEQ ID NO: 2, a substitution of L307K of SEQ ID NO: 2, a substitution of I658V of SEQ ID NO: 2, an insertion of PT at position 688 of SEQ ID NO: 2, an insertion of SA at position 794 of SEQ ID NO: 2, a substitution of S877R of SEQ ID NO: 2, a substitution of N580T of SEQ ID NO: 2, a substitution of V335G of SEQ ID NO: 2, a substitution of T620S of SEQ ID NO: 2, a substitution of W345G of SEQ ID NO: 2, a substitution of T280S of SEQ ID NO: 2, a substitution of L406P of SEQ ID NO: 2, a substitution of A612D of SEQ ID NO: 2, a substitution of A751S of SEQ ID NO: 2, a substitution of E386R of SEQ ID NO: 2, a substitution of V351M of SEQ ID NO: 2, a substitution of K210N of SEQ ID NO: 2, a substitution of D40A of SEQ ID NO: 2, a substitution of E773G of SEQ ID NO: 2, a substitution of H207L of SEQ ID NO: 2, a substitution of T62A SEQ ID NO: 2, a substitution of T287P of SEQ ID NO: 2, a substitution of T832A of SEQ ID NO: 2, a substitution of A893S of SEQ ID NO: 2, an insertion of V at position 14 of SEQ ID NO: 2, an insertion of AG at position 13 of SEQ ID NO: 2, a substitution of R11V of SEQ ID NO: 2, a substitution of R12N of SEQ ID NO: 2, a substitution of R13H of SEQ ID NO: 2, an insertion of Y at position 13 of SEQ ID NO: 2, a substitution of R12L of SEQ ID NO: 2, an insertion of Q at position 13 of SEQ ID NO: 2, an substitution of V15S of SEQ ID NO: 2, an insertion of D at position 17 of SEQ ID NO: 2 or a combination thereof.

In some embodiments, the CasX variant comprises at least one modification in the NTSB domain.

In some embodiments, the CasX variant comprises at least one modification in the TSL domain. In some embodiments, the at least one modification in the TSL domain comprises an amino acid substitution of one or more of amino acids Y857, S890, or S932 of SEQ ID NO: 2.

In some embodiments, the CasX variant comprises at least one modification in the helical I domain. In some embodiments, the at least one modification in the helical I domain comprises an amino acid substitution of one or more of amino acids S219, L249, E259, Q252, E292, L307, or D318 of SEQ ID NO: 2.

In some embodiments, the CasX variant comprises at least one modification in the helical II domain. In some embodiments, the at least one modification in the helical II domain comprises an amino acid substitution of one or more of amino acids D361, L379, E385, E386, D387, F399, L404, R458, C477, or D489 of SEQ ID NO: 2.

In some embodiments, the CasX variant comprises at least one modification in the OBD domain. In some embodiments, the at least one modification in the OBD comprises an amino acid substitution of one or more of amino acids F536, E552, T620, or I658 of SEQ ID NO: 2.

In some embodiments, the CasX variant comprises at least one modification in the RuvC DNA cleavage domain. In some embodiments, the at least one modification in the RuvC DNA cleavage domain comprises an amino acid substitution of one or more of amino acids K682, G695, A708, V711, D732, A739, D733, L742, V747, F755, M771, M779, W782, A788, G791, L792, P793, Y797, M799, Q804, S819, or Y857 or a deletion of amino acid P793 of SEQ ID NO: 2.

In some embodiments, the CasX variant comprises at least one modification compared to the reference CasX sequence of SEQ ID NO: 2 is selected from one or more of: (a) an amino acid substitution of L379R; (b) an amino acid substitution of A708K; (c) an amino acid substitution of T620P; (d) an amino acid substitution of E385P; (e) an amino acid substitution of Y857R; (f) an amino acid substitution of I658V; (g) an amino acid substitution of F399L; (h) an amino acid substitution of Q252K; (i) an amino acid substitution of L404K; and (j) an amino acid deletion of P793.

In some embodiments, a CasX variant protein comprises at least two amino acid changes to a reference CasX protein amino acid sequence. The at least two amino acid changes can be substitutions, insertions, or deletions of a reference CasX protein amino acid sequence, or any combination thereof. The substitutions, insertions or deletions can be any substitution, insertion or deletion in the sequence of a reference CasX protein described herein. In some embodiments, the changes are contiguous, non-contiguous, or a combination of contiguous and non-contiguous amino acid changes to a reference CasX protein sequence. In some embodiments, the reference CasX protein is SEQ ID NO: 2. In some embodiments, a CasX variant protein comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, at least 40, at least 45, at least 50, at least 55, at least 60, at least 65, at least 70, at least 75, at least 80, at least 85, at least 90, at least 95 or at least 100 amino acid changes to a reference CasX protein sequence. In some embodiments, a CasX variant protein comprises 1-50, 3-40, 5-30, 5-20, 5-15, 5-10, 10-50, 10-40, 10-30, 10-20, 15-50, 15-40, 15-30, 2-25, 2-24, 2-22, 2-23, 2-22, 2-21, 2-20, 2-19, 2-18, 2-17, 2-16, 2-15, 2-14, 2-12, 2-11, 2-10, 2-9, 2-8, 2-7, 2-6, 2-5, 2-4, 2-3, 3-25, 3-24, 3-22, 3-23, 3-22, 3-21, 3-20, 3-19, 3-18, 3-17, 3-16, 3-15, 3-14, 3-12, 3-11, 3-10, 3-9, 3-8, 3-7, 3-6, 3-5, 3-4, 4-25, 4-24, 4-22, 4-23, 4-22, 4-21, 4-20, 4-19, 4-18, 4-17, 4-16, 4-15, 4-14, 4-12, 4-11, 4-10, 4-9, 4-8, 4-7, 4-6, 4-5, 5-25, 5-24, 5-22, 5-23, 5-22, 5-21, 5-20, 5-19, 5-18, 5-17, 5-16, 5-15, 5-14, 5-12, 5-11, 5-10, 5-9, 5-8, 5-7 or 5-6 amino acid changes to a reference CasX protein sequence. In some embodiments, a CasX variant protein comprises 15-20 changes to a reference CasX protein sequence. In some embodiments, a CasX variant protein comprises 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acid changes to a reference CasX protein sequence. In some embodiments, the at least two amino acid changes to the sequence of a reference CasX variant protein are selected from the group consisting of: a substitution of Y789T of SEQ ID NO: 2, a deletion of P793 of SEQ ID NO: 2, a substitution of Y789D of SEQ ID NO: 2, a substitution of T72S of SEQ ID NO: 2, a substitution of I546V of SEQ ID NO: 2, a substitution of E552A of SEQ ID NO: 2, a substitution of A636D of SEQ ID NO: 2, a substitution of F536S of SEQ ID NO:2, a substitution of A708K of SEQ ID NO: 2, a substitution of Y797L of SEQ ID NO: 2, a substitution of L792G SEQ ID NO: 2, a substitution of A739V of SEQ ID NO: 2, a substitution of G791M of SEQ ID NO: 2, an insertion of A at position 661 of SEQ ID NO: 2, a substitution of A788W of SEQ ID NO: 2, a substitution of K390R of SEQ ID NO: 2, a substitution of A751S of SEQ ID NO: 2, a substitution of E385A of SEQ ID NO: 2, an insertion of P at position 696 of SEQ ID NO: 2, an insertion of M at position 773 of SEQ ID NO: 2, a substitution of G695H of SEQ ID NO: 2, an insertion of AS at position 793 of SEQ ID NO: 2, an insertion of AS at position 795 of SEQ ID NO: 2, a substitution of C477R of SEQ ID NO: 2, a substitution of C477K of SEQ ID NO: 2, a substitution of C479A of SEQ ID NO: 2, a substitution of C479L of SEQ ID NO: 2, a substitution of I55F of SEQ ID NO: 2, a substitution of K210R of SEQ ID NO: 2, a substitution of C233S of SEQ ID NO: 2, a substitution of D231N of SEQ ID NO: 2, a substitution of Q338E of SEQ ID NO: 2, a substitution of Q338R of SEQ ID NO: 2, a substitution of L379R of SEQ ID NO: 2, a substitution of K390R of SEQ ID NO: 2, a substitution of L481Q of SEQ ID NO: 2, a substitution of F495S of SEQ ID NO:2, a substitution of D600N of SEQ ID NO: 2, a substitution of T886K of SEQ ID NO: 2, a substitution of A739V of SEQ ID NO: 2, a substitution of K460N of SEQ ID NO: 2, a substitution of I199F of SEQ ID NO: 2, a substitution of G492P of SEQ ID NO: 2, a substitution of T153I of SEQ ID NO: 2, a substitution of R591I of SEQ ID NO: 2, an insertion of AS at position 795 of SEQ ID NO: 2, an insertion of AS at position 796 of SEQ ID NO:2, an insertion of L at position 889 of SEQ ID NO: 2, a substitution of E121D of SEQ ID NO: 2, a substitution of S270W of SEQ ID NO: 2, a substitution of E712Q of SEQ ID NO: 2, a substitution of K942Q of SEQ ID NO: 2, a substitution of E552K of SEQ ID NO:2, a substitution of K25Q of SEQ ID NO: 2, a substitution of N47D of SEQ ID NO: 2, an insertion of T at position 696 of SEQ ID NO: 2, a substitution of L685I of SEQ ID NO: 2, a substitution of N880D of SEQ ID NO: 2, a substitution of Q102R of SEQ ID NO: 2, a substitution of M734K of SEQ ID NO: 2, a substitution of A724S of SEQ ID NO: 2, a substitution of T704K of SEQ ID NO: 2, a substitution of P224K of SEQ ID NO: 2, a substitution of K25R of SEQ ID NO: 2, a substitution of M29E of SEQ ID NO: 2, a substitution of H152D of SEQ ID NO: 2, a substitution of S219R of SEQ ID NO: 2, a substitution of E475K of SEQ ID NO: 2, a substitution of G226R of SEQ ID NO: 2, a substitution of A377K of SEQ ID NO: 2, a substitution of E480K of SEQ ID NO: 2, a substitution of K416E of SEQ ID NO: 2, a substitution of H164R of SEQ ID NO: 2, a substitution of K767R of SEQ ID NO: 2, a substitution of I7F of SEQ ID NO: 2, a substitution of M29R of SEQ ID NO: 2, a substitution of H435R of SEQ ID NO: 2, a substitution of E385Q of SEQ ID NO: 2, a substitution of E385K of SEQ ID NO: 2, a substitution of I279F of SEQ ID NO: 2, a substitution of D489S of SEQ ID NO: 2, a substitution of D732N of SEQ ID NO: 2, a substitution of A739T of SEQ ID NO: 2, a substitution of W885R of SEQ ID NO: 2, a substitution of E53K of SEQ ID NO: 2, a substitution of A238T of SEQ ID NO: 2, a substitution of P283Q of SEQ ID NO: 2, a substitution of E292K of SEQ ID NO: 2, a substitution of Q628E of SEQ ID NO: 2, a substitution of R388Q of SEQ ID NO: 2, a substitution of G791M of SEQ ID NO: 2, a substitution of L792K of SEQ ID NO: 2, a substitution of L792E of SEQ ID NO: 2, a substitution of M779N of SEQ ID NO: 2, a substitution of G27D of SEQ ID NO: 2, a substitution of K955R of SEQ ID NO: 2, a substitution of S867R of SEQ ID NO: 2, a substitution of R693I of SEQ ID NO: 2, a substitution of F189Y of SEQ ID NO: 2, a substitution of V635M of SEQ ID NO: 2, a substitution of F399L of SEQ ID NO: 2, a substitution of E498K of SEQ ID NO: 2, a substitution of E386R of SEQ ID NO: 2, a substitution of V254G of SEQ ID NO: 2, a substitution of P793S of SEQ ID NO: 2, a substitution of K188E of SEQ ID NO: 2, a substitution of QT945KI of SEQ ID NO: 2, a substitution of T620P of SEQ ID NO: 2, a substitution of T946P of SEQ ID NO: 2, a substitution of TT949PP of SEQ ID NO: 2, a substitution of N952T of SEQ ID NO: 2, a substitution of K682E of SEQ ID NO: 2, a substitution of K975R of SEQ ID NO: 2, a substitution of L212P of SEQ ID NO: 2, a substitution of E292R of SEQ ID NO: 2, a substitution of I303K of SEQ ID NO: 2, a substitution of C349E of SEQ ID NO: 2, a substitution of E385P of SEQ ID NO: 2, a substitution of E386N of SEQ ID NO: 2, a substitution of D387K of SEQ ID NO: 2, a substitution of L404K of SEQ ID NO: 2, a substitution of E466H of SEQ ID NO: 2, a substitution of C477Q of SEQ ID NO: 2, a substitution of C477H of SEQ ID NO: 2, a substitution of C479A of SEQ ID NO: 2, a substitution of D659H of SEQ ID NO: 2, a substitution of T806V of SEQ ID NO: 2, a substitution of K808S of SEQ ID NO: 2, an insertion of AS at position 797 of SEQ ID NO: 2, a substitution of V959M of SEQ ID NO: 2, a substitution of K975Q of SEQ ID NO: 2, a substitution of W974G of SEQ ID NO: 2, a substitution of A708Q of SEQ ID NO: 2, a substitution of V711K of SEQ ID NO: 2, a substitution of D733T of SEQ ID NO: 2, a substitution of L742W of SEQ ID NO: 2, a substitution of V747K of SEQ ID NO: 2, a substitution of F755M of SEQ ID NO: 2, a substitution of M771A of SEQ ID NO: 2, a substitution of M771Q of SEQ ID NO: 2, a substitution of W782Q of SEQ ID NO: 2, a substitution of G791F, of SEQ ID NO: 2 a substitution of L792D of SEQ ID NO: 2, a substitution of L792K of SEQ ID NO: 2, a substitution of P793Q of SEQ ID NO: 2, a substitution of P793G of SEQ ID NO: 2, a substitution of Q804A of SEQ ID NO: 2, a substitution of Y966N of SEQ ID NO: 2, a substitution of Y723N of SEQ ID NO: 2, a substitution of Y857R of SEQ ID NO: 2, a substitution of S890R of SEQ ID NO: 2, a substitution of S932M of SEQ ID NO: 2, a substitution of L897M of SEQ ID NO: 2, a substitution of R624G of SEQ ID NO: 2, a substitution of S603G of SEQ ID NO: 2, a substitution of N737S of SEQ ID NO: 2, a substitution of L307K of SEQ ID NO: 2, a substitution of I658V of SEQ ID NO: 2, an insertion of PT at position 688 of SEQ ID NO: 2, an insertion of SA at position 794 of SEQ ID NO: 2, a substitution of S877R of SEQ ID NO: 2, a substitution of N580T of SEQ ID NO: 2, a substitution of V335G of SEQ ID NO: 2, a substitution of T620S of SEQ ID NO: 2, a substitution of W345G of SEQ ID NO: 2, a substitution of T280S of SEQ ID NO: 2, a substitution of L406P of SEQ ID NO: 2, a substitution of A612D of SEQ ID NO: 2, a substitution of A751S of SEQ ID NO: 2, a substitution of E386R of SEQ ID NO: 2, a substitution of V351M of SEQ ID NO: 2, a substitution of K210N of SEQ ID NO: 2, a substitution of D40A of SEQ ID NO: 2, a substitution of E773G of SEQ ID NO: 2, a substitution of H207L of SEQ ID NO: 2, a substitution of T62A SEQ ID NO: 2, a substitution of T287P of SEQ ID NO: 2, a substitution of T832A of SEQ ID NO: 2, a substitution of A893S of SEQ ID NO: 2, an insertion of V at position 14 of SEQ ID NO: 2, an insertion of AG at position 13 of SEQ ID NO: 2, a substitution of R11V of SEQ ID NO: 2, a substitution of R12N of SEQ ID NO: 2, a substitution of R13H of SEQ ID NO: 2, an insertion of Y at position 13 of SEQ ID NO: 2, a substitution of R12L of SEQ ID NO: 2, an insertion of Q at position 13 of SEQ ID NO: 2, an substitution of V15S of SEQ ID NO: 2 and an insertion of D at position 17 of SEQ ID NO: 2. In some embodiments, the at least two amino acid changes to a reference CasX protein are selected from the amino acid changes disclosed in the sequences of Table 3. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, the reference CasX protein comprises or consists essentially of SEQ ID NO: 2. In some embodiments, a CasX variant protein comprises a substitution of S794R and a substitution of Y797L of SEQ ID NO: 2. In some embodiments, a CasX variant protein comprises a substitution of K416E and a substitution of A708K of SEQ ID NO: 2. In some embodiments, a CasX variant protein comprises a substitution of A708K and a deletion of P793 of SEQ ID NO: 2. In some embodiments, a CasX variant protein comprises a deletion of P793 and an insertion of AS at position 795 SEQ ID NO: 2. In some embodiments, a CasX variant protein comprises a substitution of Q367K and a substitution of I425S of SEQ ID NO: 2. In some embodiments, a CasX variant protein comprises a substitution of A708K, a deletion of P position 793 and a substitution A793V of SEQ ID NO: 2. In some embodiments, a CasX variant protein comprises a substitution of Q338R and a substitution of A339E of SEQ ID NO: 2. In some embodiments, a CasX variant protein comprises a substitution of Q338R and a substitution of A339K of SEQ ID NO: 2. In some embodiments, a CasX variant protein comprises a substitution of S507G and a substitution of G508R of SEQ ID NO: 2. In some embodiments, a CasX variant protein comprises a substitution of L379R, a substitution of A708K and a deletion of P at position 793 of SEQ ID NO: 2. In some embodiments, a CasX variant protein comprises a substitution of C477K, a substitution of A708K and a deletion of P at position 793 of SEQ ID NO: 2. In some embodiments, a CasX variant protein comprises a substitution of L379R, a substitution of C477K, a substitution of A708K and a deletion of P at position of 793 of SEQ ID NO: 2. In some embodiments, a CasX variant protein comprises a substitution of L379R, a substitution of A708K, a deletion of P at position 793 and a substitution A739V of SEQ ID NO: 2. In some embodiments, a CasX variant protein comprises a substitution of C477K, a substitution of A708K, a deletion of P at position 793 and a substitution of A739V of SEQ ID NO: 2. In some embodiments, a CasX variant protein comprises a substitution of L379R, a substitution of C477K, a substitution of A708K, a deletion of P at position 793 and a substitution of A739V of SEQ ID NO: 2. In some embodiments, a CasX variant protein comprises a substitution of L379R, a substitution of A708K, a deletion of P at position 793 and a substitution of M779N of SEQ ID NO: 2. In some embodiments, a CasX variant protein comprises a substitution of L379R, a substitution of A708K, a deletion of P at position 793 and a substitution of M771N of SEQ ID NO: 2. In some embodiments, a CasX variant protein comprises a substitution of L379R, a substitution of 708K, a deletion of P at position 793 and a substitution of D489S of SEQ ID NO: 2. In some embodiments, a CasX variant protein comprises a substitution of L379R, a substitution of A708K, a deletion of P at position 793 and a substitution of A739T of SEQ ID NO: 2. In some embodiments, a CasX variant protein comprises a substitution of L379R, a substitution of A708K, a deletion of P at position 793 and a substitution of D732N of SEQ ID NO: 2. In some embodiments, a CasX variant protein comprises a substitution of L379R, a substitution of A708K, a deletion of P at position 793 and a substitution of G791M of SEQ ID NO: 2. In some embodiments, a CasX variant protein comprises a substitution of L379R, a substitution of 708K, a deletion of P at position 793 and a substitution of Y797L of SEQ ID NO: 2. In some embodiments, a CasX variant protein comprises a substitution of L379R, a substitution of C477K, a substitution of A708K, a deletion of P at position 793 and a substitution of M779N of SEQ ID NO: 2. In some embodiments, a CasX variant protein comprises a substitution of L379R, a substitution of C477K, a substitution of A708K, a deletion of P at position 793 and a substitution of M771N of SEQ ID NO: 2. In some embodiments, a CasX variant protein comprises a substitution of L379R, a substitution of C477K, a substitution of A708K, a deletion of P at position 793 and a substitution of D489S of SEQ ID NO: 2. In some embodiments, a CasX variant protein comprises a substitution of L379R, a substitution of C477K, a substitution of A708K, a deletion of P at position 793 and a substitution of A739T of SEQ ID NO: 2. In some embodiments, a CasX variant protein comprises a substitution of L379R, a substitution of C477K, a substitution of A708K, a deletion of P at position 793 and a substitution of D732N of SEQ ID NO: 2. In some embodiments, a CasX variant protein comprises a substitution of L379R, a substitution of C477K, a substitution of A708K, a deletion of P at position 793 and a substitution of G791M of SEQ ID NO: 2. In some embodiments, a CasX variant protein comprises a substitution of L379R, a substitution of C477K, a substitution of A708K, a deletion of P at position 793 and a substitution of Y797L of SEQ ID NO: 2. In some embodiments, a CasX variant protein comprises a substitution of L379R, a substitution of C477K, a substitution of A708K, a deletion of P at position 793 and a substitution of T620P of SEQ ID NO: 2. In some embodiments, a CasX variant protein comprises a substitution of A708K, a deletion of P at position 793 and a substitution of E386S of SEQ ID NO: 2. In some embodiments, a CasX variant protein comprises a substitution of E386R, a substitution of F399L and a deletion of P at position 793 of SEQ ID NO: 2. In some embodiments, a CasX variant protein comprises a substitution of R581I and A739V of SEQ ID NO: 2. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, a CasX variant protein comprises a substitution of A708K, a deletion of P at position 793 and a substitution of A739V of SEQ ID NO: 2. In some embodiments, a CasX variant protein comprises a substitution of L379R, a substitution of A708K and a deletion of P at position 793 of SEQ ID NO: 2. In some embodiments, a CasX variant protein comprises a substitution of C477K, a substitution of A708K and a deletion of P at position 793 of SEQ ID NO: 2. In some embodiments, a CasX variant protein comprises a substitution of L379R, a substitution of C477K, a substitution of A708K and a deletion of P at position 793 of SEQ ID NO: 2. In some embodiments, a CasX variant protein comprises a substitution of L379R, a substitution of A708K, a deletion of P at position 793 and a substitution of A739V of SEQ ID NO: 2. In some embodiments, a CasX variant protein comprises a substitution of C477K, a substitution of A708K, a deletion of P at position 793 and a substitution of A739 of SEQ ID NO: 2. In some embodiments, a CasX variant protein comprises a substitution of L379R, a substitution of C477K, a substitution of A708K, a deletion of P at position 793 and a substitution of A739V of SEQ ID NO: 2. In some embodiments, a CasX variant protein comprises a substitution of L379R, a substitution of C477K, a substitution of A708K, a deletion of P at position 793 and a substitution of T620P of SEQ ID NO: 2. In some embodiments, a CasX variant protein comprises a substitution of M771A of SEQ ID NO: 2. In some embodiments, a CasX variant protein comprises a substitution of L379R, a substitution of A708K, a deletion of P at position 793 and a substitution of D732N of SEQ ID NO: 2. In some embodiments, a CasX variant comprises any combination of the foregoing embodiments of this paragraph.

In some embodiments, a CasX variant protein comprises a substitution of W782Q of SEQ ID NO: 2. In some embodiments, a CasX variant protein comprises a substitution of M771Q of SEQ ID NO: 2. In some embodiments, a CasX variant protein comprises a substitution of R458I and a substitution of A739V of SEQ ID NO: 2. In some embodiments, a CasX variant protein comprises a substitution of L379R, a substitution of A708K, a deletion of P at position 793 and a substitution of M771N of SEQ ID NO: 2. In some embodiments, a CasX variant protein comprises a substitution of L379R, a substitution of A708K, a deletion of P at position 793 and a substitution of A739T of SEQ ID NO: 2. In some embodiments, a CasX variant protein comprises a substitution of L379R, a substitution of C477K, a substitution of A708K, a deletion of P at position 793 and a substitution of D489S of SEQ ID NO: 2. In some embodiments, a CasX variant protein comprises a substitution of L379R, a substitution of C477K, a substitution of A708K, a deletion of P at position 793 and a substitution of D732N of SEQ ID NO: 2. In some embodiments, a CasX variant protein comprises a substitution of V711K of SEQ ID NO: 2. In some embodiments, a CasX variant protein comprises a substitution of L379R, a substitution of C477K, a substitution of A708K, a deletion of P at position 793 and a substitution of Y797L of SEQ ID NO: 2. In some embodiments, a CasX variant protein comprises a substitution of L379R, a substitution of A708K and a deletion of P at position 793 of SEQ ID NO: 2. In some embodiments, a CasX variant protein comprises a substitution of L379R, a substitution of C477K, a substitution of A708K, a deletion of P at position 793 and a substitution of M771N of SEQ ID NO: 2. In some embodiments, a CasX variant protein comprises a substitution of A708K, a substitution of P at position 793 and a substitution of E386S of SEQ ID NO: 2. In some embodiments, a CasX variant protein comprises a substitution of L379R, a substitution of C477K, a substitution of A708K and a deletion of P at position 793 of SEQ ID NO: 2. In some embodiments, a CasX variant protein comprises a substitution of L792D of SEQ ID NO: 2. In some embodiments, a CasX variant protein comprises a substitution of G791F of SEQ ID NO: 2. In some embodiments, a CasX variant protein comprises a substitution of A708K, a deletion of P at position 793 and a substitution of A739V of SEQ ID NO: 2. In some embodiments, a CasX variant protein comprises a substitution of L379R, a substitution of A708K, a deletion of P at position 793 and a substitution of A739V of SEQ ID NO: 2. In some embodiments, a CasX variant protein comprises a substitution of C477K, a substitution of A708K and a substitution of P at position 793 of SEQ ID NO: 2. In some embodiments, a CasX variant protein comprises a substitution of L249I and a substitution of M771N of SEQ ID NO: 2. In some embodiments, a CasX variant protein comprises a substitution of V747K of SEQ ID NO: 2. In some embodiments, a CasX variant protein comprises a substitution of L379R, a substitution of C477, a substitution of A708K, a deletion of P at position 793 and a substitution of M779N of SEQ ID NO: 2. In some embodiments, a CasX variant protein comprises a substitution of F755M. In some embodiments, a CasX variant comprises any combination of the foregoing embodiments of this paragraph.

In some embodiments, a CasX variant protein comprises at least one modification compared to the reference CasX sequence of SEQ ID NO: 2, wherein the at least one modification is selected from one or more of: an amino acid substitution of L379R; an amino acid substitution of A708K; an amino acid substitution of T620P; an amino acid substitution of E385P; an amino acid substitution of Y857R; an amino acid substitution of I658V; an amino acid substitution of F399L; an amino acid substitution of Q252K; an amino acid substitution of L404K; and an amino acid deletion of [P793]. In other embodiments, a CasX variant protein comprises any combination of the foregoing substitutions or deletions compared to the reference CasX sequence of SEQ ID NO: 2. In other embodiments, the CasX variant protein can, in addition to the foregoing substitutions or deletions, further comprise a substitution of an NTSB and/or a helical 1b domain from the reference CasX of SEQ ID NO: 1.

In some embodiments, a CasX variant comprises any one of SEQ ID NOS: 247-337, 3301-3493, 3498-3501, 3505-3520, 3540-3549 and 4412-4415. In some embodiments, a CasX variant comprises any one of SEQ ID NOS: 247-337, 3498-3501, 3505-3520, 3540-3549 and 4412-4415. In some embodiments, a CasX variant comprises any one of SEQ ID NOS: 3498-3501, 3505-3520 and 3540-3549.

In some embodiments, a CasX variant comprises one or modifications to any one of SEQ ID NOS: 247-337, 3301-3493, 3498-3501, 3505-3520, 3540-3549 and 4412-4415. In some embodiments, a CasX variant comprises one or modifications to any one of SEQ ID NOS: 247-337, 3498-3501, 3505-3520, 3540-3549 and 4412-4415. In some embodiments, a CasX variant comprises one or modifications to any one of SEQ ID NOS: 3498-3501, 3505-3520 and 3540-3549.

In some embodiments, the CasX variant protein comprises between 400 and 2000 amino acids, between 500 and 1500 amino acids, between 700 and 1200 amino acids, between 800 and 1100 amino acids or between 900 and 1000 amino acids.

In some embodiments, the CasX variant protein comprises one or more modifications in a region of non-contiguous residues that form a channel in which gNA:target DNA complexing occurs. In some embodiments, the CasX variant protein comprises one or more modifications comprising a region of non-contiguous residues that form an interface which binds with the gNA. For example, in some embodiments of a reference CasX protein, the helical I, helical II and OBD domains all contact or are in proximity to the gNA:target DNA complex, and one or more modifications to non-contiguous residues within any of these domains may improve function of the CasX variant protein.

In some embodiments, the CasX variant protein comprises one or more modifications in a region of non-contiguous residues that form a channel which binds with the non-target strand DNA. For example, a CasX variant protein can comprise one or more modifications to non-contiguous residues of the NTSBD. In some embodiments, the CasX variant protein comprises one or more modifications in a region of non-contiguous residues that form an interface which binds with the PAM. For example, a CasX variant protein can comprise one or more modifications to non-contiguous residues of the helical I domain or OBD. In some embodiments, the CasX variant protein comprises one or more modifications comprising a region of non-contiguous surface-exposed residues. As used herein, "surface-exposed residues" refers to amino acids on the surface of the CasX protein, or amino acids in which at least a portion of the amino acid, such as the backbone or a part of the side chain is on the surface of the protein. Surface exposed residues of cellular proteins such as CasX, which are exposed to an aqueous intracellular environment, are frequently selected from positively charged hydrophilic amino acids, for example arginine, asparagine, aspartate, glutamine, glutamate, histidine, lysine, serine, and threonine. Thus, for example, in some embodiments of the variants provided herein, a region of surface exposed residues comprises one or more insertions, deletions, or substitutions compared to a reference CasX protein. In some embodiments, one or more positively charged residues are substituted for one or more other positively charged residues, or negatively charged residues, or uncharged residues, or any combinations thereof. In some embodiments, one or more amino acids residues for substitution are near bound nucleic acid, for example residues in the RuvC domain or helical I domain that contact target DNA, or residues in the OBD or helical II domain that bind the gNA, can be substituted for one or more positively charged or polar amino acids.

In some embodiments, the CasX variant protein comprises one or more modifications in a region of non-contiguous residues that form a core through hydrophobic packing in a domain of the reference CasX protein. Without wishing to be bound by any theory, regions that form cores through hydrophobic packing are rich in hydrophobic amino acids such as valine, isoleucine, leucine, methionine, phenylalanine, tryptophan, and cysteine. For example, in some reference CasX proteins, RuvC domains comprise a hydrophobic pocket adjacent to the active site. In some embodiments, between 2 to 15 residues of the region are charged, polar, or base-stacking. Charged amino acids (sometimes referred to herein as residues) may include, for example, arginine, lysine, aspartic acid, and glutamic acid, and the side chains of these amino acids may form salt bridges provided a bridge partner is also present (see FIG. 14). Polar amino acids may include, for example, glutamine, asparagine, histidine, serine, threonine, tyrosine, and cysteine. Polar amino acids can, in some embodiments, form hydrogen bonds as proton donors or acceptors, depending on the identity of their side chains. As used herein, "base-stacking" includes the interaction of aromatic side chains of an amino acid residue (such as tryptophan, tyrosine, phenylalanine, or histidine) with stacked nucleotide bases in a nucleic acid. Any modification to a region of non-contiguous amino acids that are in close spatial proximity to form a functional part of the CasX variant protein is envisaged as within the scope of the disclosure.

i. CasX Variant Proteins with Domains from Multiple Source Proteins

In certain embodiments, the disclosure provides a chimeric CasX protein comprising protein domains from two or more different CasX proteins, such as two or more naturally occurring CasX proteins, or two or more CasX variant protein sequences as described herein. As used herein, a "chimeric CasX protein" refers to a CasX containing at least two domains isolated or derived from different sources, such as two naturally occurring proteins, which may, in some embodiments, be isolated from different species. For example, in some embodiments, a chimeric CasX protein comprises a first domain from a first CasX protein and a second domain from a second, different CasX protein. In some embodiments, the first domain can be selected from the group consisting of the NTSB, TSL, helical I, helical II, OBD and RuvC domains. In some embodiments, the second domain is selected from the group consisting of the NTSB, TSL, helical I, helical II, OBD and RuvC domains with the second domain being different from the foregoing first domain. For example, a chimeric CasX protein may comprise an NTSB, TSL, helical I, helical II, OBD domains from a CasX protein of SEQ ID NO: 2, and a RuvC domain from a CasX protein of SEQ ID NO: 1, or vice versa. As a further example, a chimeric CasX protein may comprise an NTSB, TSL, helical II, OBD and RuvC domain from CasX protein of SEQ ID NO: 2, and a helical I domain from a CasX protein of SEQ ID NO: 1, or vice versa. Thus, in certain embodiments, a chimeric CasX protein may comprise an NTSB, TSL, helical II, OBD and RuvC domain from a first CasX protein, and a helical I domain from a second CasX protein. In some embodiments of the chimeric CasX proteins, the domains of the first CasX protein are derived from the sequences of SEQ ID NO: 1, SEQ ID NO: 2 or SEQ ID NO: 3, and the domains of the second CasX protein are derived from the sequences of SEQ ID NO: 1, SEQ ID NO: 2 or SEQ ID NO: 3, and the first and second CasX proteins are not the same. In some embodiments, domains of the first CasX protein comprise sequences derived from SEQ ID NO: 1 and domains of the second CasX protein comprise sequences derived from SEQ ID NO: 2. In some embodiments, domains of the first CasX protein comprise sequences derived from SEQ ID NO: 1 and domains of the second CasX protein comprise sequences derived from SEQ ID NO: 3. In some embodiments, domains of the first CasX protein comprise sequences derived from SEQ ID NO: 2 and domains of the second CasX protein comprise sequences derived from SEQ ID NO: 3. In some embodiments, the CasX variant is selected of group consisting of CasX variants with sequences of SEQ ID NO: 328, SEQ ID NO: 3540, SEQ ID NO: 4413, SEQ ID NO: 4414, SEQ ID NO: 4415, SEQ ID NO: 329, SEQ ID NO: 3541, SEQ ID NO: 330, SEQ ID NO: 3542, SEQ ID NO: 331, SEQ ID NO: 3543, SEQ ID NO: 332, SEQ ID NO: 3544, SEQ ID NO: 333, SEQ ID NO: 3545, SEQ ID NO: 334, SEQ ID NO: 3546, SEQ ID NO: 335, SEQ ID NO: 3547, SEQ ID NO: 336 and SEQ ID NO: 3548. In some embodiments, the CasX variant comprises one or more additional modifications to any one of SEQ ID NO: 328, SEQ ID NO: 3540, SEQ ID NO: 4413, SEQ ID NO: 4414, SEQ ID NO: 4415, SEQ ID NO: 329, SEQ ID NO: 3541, SEQ ID NO: 330, SEQ ID NO: 3542, SEQ ID NO: 331, SEQ ID NO: 3543, SEQ ID NO: 332, SEQ ID NO: 3544, SEQ ID NO: 333, SEQ ID NO: 3545, SEQ ID NO: 334, SEQ ID NO: 3546, SEQ ID NO: 335, SEQ ID NO: 3547, SEQ ID NO: 336 or SEQ ID NO: 3548. In some embodiments, the one or more additional modifications comprises an insertion, substitution or deletion as described herein.

In some embodiments, a CasX variant protein comprises at least one chimeric domain comprising a first part from a first CasX protein and a second part from a second, different CasX protein. As used herein, a "chimeric domain" refers to a domain containing at least two parts isolated or derived from different sources, such as two naturally occurring proteins or portions of domains from two reference CasX proteins. The at least one chimeric domain can be any of the NTSB, TSL, helical I, helical II, OBD or RuvC domains as described herein. In some embodiments, the first portion of a CasX domain comprises a sequence of SEQ ID NO: 1 and the second portion of a CasX domain comprises a sequence of SEQ ID NO: 2. In some embodiments, the first portion of the CasX domain comprises a sequence of SEQ ID NO: 1 and the second portion of the CasX domain comprises a sequence of SEQ ID NO: 3. In some embodiments, the first portion of the CasX domain comprises a sequence of SEQ ID NO: 2 and the second portion of the CasX domain comprises a sequence of SEQ ID NO: 3. In some embodiments, the at least one chimeric domain comprises a chimeric RuvC domain. As an example of the foregoing, the chimeric RuvC domain comprises amino acids 661 to 824 of SEQ ID NO: 1 and amino acids 922 to 978 of SEQ ID NO: 2. As an alternative example of the foregoing, a chimeric RuvC domain comprises amino acids 648 to 812 of SEQ ID NO: 2 and amino acids 935 to 986 of SEQ ID NO: 1. In some embodiments, a CasX protein comprises a first domain from a first CasX protein and a second domain from a second CasX protein, and at least one chimeric domain comprising at least two parts isolated from different CasX proteins using the approach of the embodiments described in this paragraph. In the foregoing embodiments, the chimeric CasX proteins having domains or portions of domains derived from SEQ ID NOS: 1, 2 and 3, can further comprise amino acid insertions, deletions, or substitutions of any of the embodiments disclosed herein.

In some embodiments, a CasX variant protein comprises a sequence set forth in Tables 3, 8, 9, 10 or 12. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence set forth in Tables 3, 8, 9, 10 or 12. In other embodiments, a CasX variant protein comprises a sequence set forth in Table 3, and further comprises one or more NLS disclosed herein on either the N-terminus, the C-terminus, or both. It will be understood that in some cases, the N-terminal methionine of the CasX variants of the Tables is removed from the expressed CasX variant during post-translational modification.

TABLE 3

CasX Variant Sequences

| Description* | Amino Acid Sequence |
| --- | --- |
| TSL, Helical I, Helical II OBD and RuvC domains from SEQ ID NO: 2 and an NTSB domain from SEQ ID NO: 1 | SEQ ID NO: 247 |
| NTSB, Helical I, Helical II, OBD and RuvC domains from SEQ ID NO: 2 and a TSL domain from SEQ ID NO: 1. | SEQ ID NO: 248 |

TABLE 3-continued

CasX Variant Sequences

| Description* | Amino Acid Sequence |
|---|---|
| TSL, Helical I, Helical II, OBD and RuvC domains from SEQ ID NO: 1 and an NTSB domain from SEQ ID NO: 2 | SEQ ID NO: 249 |
| NTSB, Helical I, Helical II, OBD and RuvC domains from SEQ ID NO: 1 and an TSL domain from SEQ ID NO: 2. | SEQ ID NO: 250 |
| NTSB, TSL, Helical I, Helical II and OBD domains SEQ ID NO: 2 and an exogenous RuvC domain or a portion thereof from a second CasX protein. | SEQ ID NO: 251 |
| No description | SEQ ID NO: 252 |
| NTSB, TSL, Helical II, OBD and RuvC domains from SEQ ID NO: 2 and a Helical I domain from SEQ ID NO: 1 | SEQ ID NO: 253 |
| NTSB, TSL, Helical I, OBD and RuvC domains from SEQ ID NO: 2 and a Helical II domain from SEQ ID NO: 1 | SEQ ID NO: 254 |
| NTSB, TSL, Helical I, Helical II and RuvC domains from a first CasX protein and an exogenous OBD or a part thereof from a second CasX protein | SEQ ID NO: 255 |
| No description | SEQ ID NO: 256 |
| Nodescription | SEQ ID NO: 257 |
| substitution of L379R, a substitution of C477K, a substitution of A708K, a deletion of P at position 793 and a substitution of T620P of SEQ ID NO: 2 | SEQ ID NO: 258 |
| substitution of M77 IA of SEQ. ID NO: 2. | SEQ ID NO: 259 |
| substitution of L379R, a substitution of A708K, a deletion of P at position 793 and a substitution of D732N of SEQ ID NO: 2. | SEQ ID NO: 260 |
| substitution of W782Q of SEQ ID NO: 2. | SEQ ID NO: 261 |
| substitution of M771Q of SEQ ID NO: 2 | SEQ ID NO: 262 |
| substitution of R458I and a substitution of A739V of SEQ ID NO: 2. | SEQ ID NO: 263 |
| L379R, a substitution of A708K, a deletion of P at position 793 and a substitution of M771N of SEQ ID NO: 2 | SEQ ID NO: 264 |
| substitution of L379R, a substitution of A708K, a deletion of P at position 793 and a stibstitution of A739T of SEQ ID NO: 2 | SEQ ID NO: 265 |
| substitution of L379R, a substitution of C477K, a substitution of A708K, a deletion of P at position 793 and a substitution of D4895 of SEQ ID NO: 2. | SEQ ID NO: 266 |
| substitution of L379R, a substitution of C477K, a substitution of A708K, a deletion of P at position 793 and a substitution of D732N of SEQ, ID NO: 2. | SEQ ID NO: 267 |
| substitution of V711K of SEQ ID NO: 2. | SEQ ID NO: 268 |
| substitution of L379R, a substitution of C477K, a substitution of A708K, a deletion of P at position 793 and a substitution of Y797L of SEQ ID NO: 2. | SEQ ID NO: 269 |
| 119, substitution of L379R, a substitution of A708K and a deletion of P at position 793 of SEQ ID NO: 2. | SEQ ID NO: 270 |
| substitution of L379R, a substitution of C477K, a substitution of A708K, a deletion of P at position 793 and a substitution of M771N of SEQ ID NO: 2. | SEQ ID NO: 271 |
| substitution of A708K, a deletion of P at position 793 and a substitution of E3865 of SEQ ID NO: 2. | SEQ ID NO: 272 |
| substitution of L379R, a substitution of C477K, a substitution of A708K and a deletion of P at position 793 of SEQ ID NO: 2. | SEQ ID NO: 273 |
| substitution of L792D of SEQ ID NO: 2. | SEQ ID NO: 274 |
| substitution of G791F of SEQ ID NO: 2. | SEQ ID NO: 275 |
| substitution of A708K, a deletion of P at position 793 and a substitution of A739V of SEQ ID NO: 2. | SEQ ID NO: 276 |
| substitution of L379R, a substitution of A708K, a deletion of P at position 793 and a substitution of A739V of SEQ ID NO: 2. | SEQ ID NO: 277 |
| substitution of C477K, a substitution of A708K and a deletion of P at position 793 of SEQ ID NO: 2. | SEQ ID NO: 278 |
| substitution of L249R and a substitution of M771N of SEQ ID NO: 2. | SEQ ID NO: 279 |
| substitution of V747K of SEQ ID NO: 2. | SEQ ID NO: 280 |
| substitution of L379R, a substitution of C477K, a substitution of A708K, a deletion of P at position 793 and a substitution of M779N of SEQ ID NO: 2. | SEQ ID NO: 281 |
| L379R, F755M | SEQ ID NO: 282 |
| 429, L379R, A708K, P793_, Y857R | SEQ ID NO: 283 |
| 430, L379R, A708K, P793_, Y857R, I658V | SEQ ID NO: 284 |
| 431, L379R, A708K, P793_, Y857R, I658V, E38614 | SEQ ID NO: 285 |
| 432, L379R, A708K, P793_, Y857R, I658V, L404K | SEQ ID NO: 286 |
| 433, L379R, A708K, P793_, Y857R, I658V, ˆV192 | SEQ ID NO: 287 |
| 434, L379R, A708K, P793_, Y857R, I658V, L404K, E386N | SEQ ID NO: 288 |
| 435, L379R, A708K, P793_, Y857R, I658V, F399L | SEQ ID NO: 289 |
| 436, L379R, A708K, P793_, Y857R, I658V, F399L, E386N | SEQ ID NO: 290 |
| 437, L379R, A708K, P793_, Y857R, I658V, F399L, C4775 | SEQ ID NO: 291 |
| 438, L379R, A708K, P793_, Y857R, I658V, F399L, L404K | SEQ ID NO: 292 |
| 439, L379R, A708K, P793_, Y857R, I658V, F399L, E386N, C4775, L404K | SEQ. ID NO: 293 |
| 440, L379R, A708K, P793_, Y857R, I658V, F399L, Y797L | SEQ ID NO: 294 |
| 441, L379R, A708K, P793_ , Y857R, I658V, F399L, Y797L, E386N | SEQ ID NO: 295 |
| 442, L379R, A708K, P793_, Y857R, I658V, F399L, Y797L, E386N, C4775, L404K | SEQ ID NO: 296 |
| 443, L379R, A708K, P793_, Y857R, I658V, Y797L | SEQ ID NO: 297 |
| 444, L379R, A708K, P793_, Y857R, I651W, Y797L, L404K | SEQ ID NO: 298 |
| 445, L379R, A708K, P793_, Y857R, I651W, Y797L, E386N | SEQ ID NO: 299 |
| 446, L379R, A708K, P793_, Y857R, I658V, Y797L, E386N, C4775, L404K | SEQ ID NO: 300 |
| 447, L379R, A708K, P793_, Y857R, E386N | SEQ ID NO: 301 |
| 448, L379R, A708K, P793_, Y857R, E386N, L404K | SEQ ID NO: 302 |
| 449, L379R, A708K, P793_, D732N, E385P, Y857R | SEQ ID NO: 303 |

TABLE 3-continued

CasX Variant Sequences

| Description* | Amino Acid Sequence |
| --- | --- |
| 450, L379R, A708K, P793_, D732N, E385P, Y857R, I651W | SEQ ID NO: 304 |
| 451, L379R, A708K, P793_, D732N, E385P, Y857R, I651W, F399L | SEQ ID NO: 305 |
| 452, L379R, A708K, P793_, D732N, E385P, Y857R, I658V, E386N | SEQ ID NO: 306 |
| 453, L379R, A708K, P793_, D732N, E385P, Y857R, I658V, L404K | SEQ ID NO: 307 |
| 454, L379R, A708K, P793_, T620P, E385P, Y857R, Q252K | SEQ ID NO: 308 |
| 455, L379R, A708K, P793_, T620P, E385P, Y857R, I651W, Q252K | SEQ ID NO: 309 |
| 456, L379R, A708K, P793_, T620P, E385P, Y857R, I651W, E386N, Q252K | SEQ ID NO: 310 |
| 457, L379R, A708K, P793_, T620P, E385P, Y857R, I658V, F399L, Q252K | SEQ ID NO: 311 |
| 458, L379R, A708K, P793_, T620P, E385P, Y85712, I651W, L404K, Q252K | SEQ ID NO: 312 |
| 459, L379R, A708K, P793_, T620P, Y857R, I658V, E386N | SEQ ID NO: 313 |
| 460, L379R, A708K, P793_ , T620P, E385P, Q252K | SEQ ID NO: 314 |
| 278 | SEQ ID NO: 315 |
| 279 | SEQ ID NO: 316 |
| 280 | SEQ ID NO: 317 |
| 285 | SEQ ID NO: 318 |
| 286 | SEQ ID NO: 319 |
| 287 | SEQ ID NO: 320 |
| 288 | SEQ ID NO: 321 |
| 290 | SEQ ID NO: 322 |
| 291 | SEQ ID NO: 323 |
| 293 | SEQ ID NO: 324 |
| 300 | SEQ ID NO: 325 |
| 492 | SEQ ID NO: 326 |
| 493 | SEQ ID NO: 327 |
| 387, NTSB swap from SEQ ID NO: 1 | SEQ ID NO: 328 |
| 395, Helical 1B swap from SEQ ID NO: 1 | SEQ ID NO: 329 |
| 485, Helical 1B swap from SEQ ID NO: 1 | SEQ ID NO: 330 |
| 486, Helical 1B swap from SEQ 1D NO: 1 | SEQ ID NO: 331 |
| 487, Helical 1B swap from SEQ ID NO: 1 | SEQ ID NO: 332 |
| 488, NTSB and Helical 1B swap from SEQ ID NO: 1 | SEQ ID NO: 333 |
| 489, NTSB and Helical 1B swap from SEQ ID NO: 1 | SEQ ID NO: 334 |
| 490, NTSB and Helical 1B swap from SEQ ID NO: 1 | SEQ ID NO: 335 |
| 491, NTSB and Helical 1B swap from SEQ ID NO: 1 | SEQ ID NO: 336 |
| 494, NTSB swap from SEQ ID NO: 1 | SEQ ID NO: 337 |
| 328, S867G | SEQ ID NO: 4412 |
| 388, L379R + A708K + [P793] + X1 Helical2 swap | SEQ ID NO: 4413 |
| 389, L379R + A708K + [P793] + X1 RuvC1 swap | SEQ ID NO: 4414 |
| 390, L379R + A708K + [P793] + X1 RuvC2 swap | SEQ ID NO: 4415 |

*Strain indicated numerically; changes, where indicated, are relative to SEQ ID NO: 2

In some embodiments, the CasX variant protein has one or more improved characteristics when compared to a reference CasX protein, for example a reference protein of SEQ ID NO: 1, SEQ ID NO: 2 or SEQ ID NO: 3. In some embodiments, an improved characteristic of the CasX variant is at least about 1.1 to about 100,000-fold improved relative to the reference protein. In some embodiments, an improved characteristic of the CasX variant is at least about 1.1 to about 10,000-fold improved, at least about 1.1 to about 1,000-fold improved, at least about 1.1 to about 500-fold improved, at least about 1.1 to about 400-fold improved, at least about 1.1 to about 300-fold improved, at least about 1.1 to about 200-fold improved, at least about 1.1 to about 100-fold improved, at least about 1.1 to about 50-fold improved, at least about 1.1 to about 40-fold improved, at least about 1.1 to about 30-fold improved, at least about 1.1 to about 20-fold improved, at least about 1.1 to about 10-fold improved, at least about 1.1 to about 9-fold improved, at least about 1.1 to about 8-fold improved, at least about 1.1 to about 7-fold improved, at least about 1.1 to about 6-fold improved, at least about 1.1 to about 5-fold improved, at least about 1.1 to about 4-fold improved, at least about 1.1 to about 3-fold improved, at least about 1.1 to about 2-fold improved, at least about 1.1 to about 1.5-fold improved, at least about 1.5 to about 3-fold improved, at least about 1.5 to about 4-fold improved, at least about 1.5 to about 5-fold improved, at least about 1.5 to about 10-fold improved, at least about 5 to about 10-fold improved, at least about 10 to about 20-fold improved, at least 10 to about 30-fold improved, at least 10 to about 50-fold improved or at least 10 to about 100-fold improved than the reference CasX protein. In some embodiments, an improved characteristic of the CasX variant is at least about 10 to about 1000-fold improved relative to the reference CasX protein.

In some embodiments, the one or more improved characteristics of the CasX variant protein is at least about 5, at least about 10, at least about 20, at least about 30, at least about 40, at least about 50, at least about 60, at least about 70, at least about 80, at least about 90, at least about 100, at least about 250, at least about 500, or at least about 1000, at least about 5,000, at least about 10,000, or at least about 100,000-fold improved relative to a reference CasX protein. In some embodiments, an improved characteristics of the CasX variant protein is at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, at least about 15, at least about 20, at least about 30, at least about 40, at least about 50, at least about 60, at least about 70, at least about 80, at least about 90 at least about 100, at least about 500, at least about 1,000, at least about 10,000, or at least about 100,000-fold improved relative to a reference CasX protein. In other cases, the one or more improved characteristics of the CasX variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference CasX of SEQ ID NO: 1, SEQ ID NO: 2 or SEQ ID NO: 3. In other cases, the one or more improved characteristics of the CasX variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold or more improved relative to the reference CasX of SEQ ID NO: 1, SEQ ID NO: 2 or SEQ ID NO: 3. Exemplary characteristics that can be improved in CasX variant proteins relative to the same characteristics in reference CasX proteins include, but are not limited to, improved folding of the variant, improved binding affinity to the gNA, improved binding affinity to the target DNA, improved ability to utilize a greater spectrum of PAM sequences in the editing and/or binding of target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved CasX:gNA RNA complex stability, improved protein solubility, improved CasX:gNA RNP complex solubility, improved protein yield, improved protein expression, and improved fusion characteristics. In some embodiments, the variant comprises at least one improved characteristic. In other embodiments, the variant comprises at least two improved characteristics. In further embodiments, the variant comprises at least three improved characteristics. In some embodiments, the variant comprises at least four improved characteristics. In still further embodiments, the variant comprises at least five, at least six, at least seven, at least eight, at least nine, at least ten, at least eleven, at least twelve, at least thirteen, or more improved characteristics. These improved characteristics are described in more detail below.

j. Protein Stability

In some embodiments, the disclosure provides a CasX variant protein with improved stability relative to a reference CasX protein. In some embodiments, improved stability of the CasX variant protein results in expression of a higher steady state of protein, which improves editing efficiency. In some embodiments, improved stability of the CasX variant protein results in a larger fraction of CasX protein that remains folded in a functional conformation and improves editing efficiency or improves purifiability for manufacturing purposes. As used herein, a "functional conformation" refers to a CasX protein that is in a conformation where the protein is capable of binding a gNA and target DNA. In embodiments wherein the CasX variant does not carry one or more mutations rendering it catalytically dead, the CasX variant is capable of cleaving, nicking, or otherwise modifying the target DNA. For example, a functional CasX variant can, in some embodiments, be used for gene-editing, and a functional conformation refers to an "editing-competent" conformation. In some exemplary embodiments, including those embodiments where the CasX variant protein results in a larger fraction of CasX protein that remains folded in a functional conformation, a lower concentration of CasX variant is needed for applications such as gene editing compared to a reference CasX protein. Thus, in some embodiments, the CasX variant with improved stability has improved efficiency compared to a reference CasX in one or more gene editing contexts.

In some embodiments, the disclosure provides a CasX variant protein having improved thermostability relative to a reference CasX protein. In some embodiments, the CasX variant protein has improved thermostability of the CasX variant protein at a particular temperature range. Without wishing to be bound by any theory, some reference CasX proteins natively function in organisms with niches in groundwater and sediment; thus, some reference CasX proteins may have evolved to exhibit optimal function at lower or higher temperatures that may be desirable for certain applications. For example, one application of CasX variant proteins is gene editing of mammalian cells, which is typically carried out at about 37° C. In some embodiments, a CasX variant protein as described herein has improved thermostability compared to a reference CasX protein at a temperature of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability and functionality compared to a reference CasX protein that results in improved gene editing functionality, such as mammalian gene editing applications, which may include human gene editing applications.

In some embodiments, the disclosure provides a CasX variant protein having improved stability of the CasX variant protein:gNA RNP complex relative to the reference CasX protein:gNA complex such that the RNP remains in a functional form. Stability improvements can include increased thermostability, resistance to proteolytic degradation, enhanced pharmacokinetic properties, stability across a range of pH conditions, salt conditions, and tonicity. Improved stability of the complex may, in some embodiments, lead to improved editing efficiency.

In some embodiments, the disclosure provides a CasX variant protein having improved thermostability of the CasX variant protein:gNA complex relative to the reference CasX protein:gNA complex. In some embodiments, a CasX variant protein has improved thermostability relative to a reference CasX protein. In some embodiments, the CasX variant protein:gNA RNP complex has improved thermostability relative to a complex comprising a reference CasX protein at temperatures of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability of the CasX variant protein: gNA RNP complex compared to a reference CasX protein: gNA complex, which results in improved function for gene editing applications, such as mammalian gene editing applications, which may include human gene editing applications.

In some embodiments, the improved stability and/or thermostability of the CasX variant protein comprises faster folding kinetics of the CasX variant protein relative to a reference CasX protein, slower unfolding kinetics of the CasX variant protein relative to a reference CasX protein, a larger free energy release upon folding of the CasX variant protein relative to a reference CasX protein, a higher temperature at which 50% of the CasX variant protein is unfolded (Tm) relative to a reference CasX protein, or any combination thereof. These characteristics may be improved by a wide range of values; for example, at least 1.1, at least 1.5, at least 10, at least 50, at least 100, at least 500, at least 1,000, at least 5,000, or at least a 10,000-fold improved, as compared to a reference CasX protein. In some embodiments, improved thermostability of the CasX variant protein comprises a higher Tm of the CasX variant protein relative to a reference CasX protein. In some embodiments, the Tm of the CasX variant protein is between about 20° C. to about 30° C., between about 30° C. to about 40° C., between about 40° C. to about 50° C., between about 50° C. to about 60° C., between about 60° C. to about 70° C., between about 70° C. to about 80° C., between about 80° C. to about 90° C. or between about 90° C. to about 100° C. Thermal stability is determined by measuring the "melting temperature" ($T_m$), which is defined as the temperature at which half of the molecules are denatured. Methods of measuring characteristics of protein stability such as Tm and the free energy of unfolding are known to persons of ordinary skill in the art, and can be measured using standard biochemical techniques in vitro. For example, Tm may be measured using Differential Scanning Calorimetry, a thermo-analytical technique in which the difference in the amount of heat required to increase the temperature of a sample and a reference is measured as a function of temperature (Chen et al (2003) Pharm Res 20:1952-60; Ghirlando et al (1999) Immunol Lett 68:47-52). Alternatively, or in addition, CasX variant protein Tm may be measured using commercially available methods such as the ThermoFisher Protein Thermal Shift system. Alternatively, or in addition, circular dichroism may be used to measure the kinetics of folding and unfolding, as well as the Tm (Murray et al. (2002) J. Chromatogr Sci 40:343-9). Circular dichroism (CD) relies on the unequal absorption of left-handed and right-handed circularly polarized light by asymmetric molecules such as proteins. Certain structures of proteins, for example alpha-helices and beta-sheets, have characteristic CD spectra. Accordingly, in some embodiments, CD may be used to determine the secondary structure of a CasX variant protein.

In some embodiments, improved stability and/or thermostability of the CasX variant protein comprises improved folding kinetics of the CasX variant protein relative to a reference CasX protein. In some embodiments, folding kinetics of the CasX variant protein are improved relative to a reference CasX protein by at least about 5, at least about 10, at least about 50, at least about 100, at least about 500, at least about 1,000, at least about 2,000, at least about 3,000, at least about 4,000, at least about 5,000, or at least about a 10,000-fold improvement. In some embodiments, folding kinetics of the CasX variant protein are improved relative to a reference CasX protein by at least about 1 kJ/mol, at least about 5 kJ/mol, at least about 10 kJ/mol, at least about 20 kJ/mol, at least about 30 kJ/mol, at least about 40 kJ/mol, at least about 50 kJ/mol, at least about 60 kJ/mol, at least about 70 kJ/mol, at least about 80 kJ/mol, at least about 90 kJ/mol, at least about 100 kJ/mol, at least about 150 kJ/mol, at least about 200 kJ/mol, at least about 250 kJ/mol, at least about 300 kJ/mol, at least about 350 kJ/mol, at least about 400 kJ/mol, at least about 450 kJ/mol, or at least about 500 kJ/mol.

Exemplary amino acid changes that can increase the stability of a CasX variant protein relative to a reference CasX protein may include, but are not limited to, amino acid changes that increase the number of hydrogen bonds within the CasX variant protein, increase the number of disulfide bridges within the CasX variant protein, increase the number of salt bridges within the CasX variant protein, strengthen interactions between parts of the CasX variant protein, increase the buried hydrophobic surface area of the CasX variant protein, or any combinations thereof.

k. Protein Yield

In some embodiments, the disclosure provides a CasX variant protein having improved yield during expression and purification relative to a reference CasX protein. In some embodiments, the yield of CasX variant proteins purified from bacterial or eukaryotic host cells is improved relative to a reference CasX protein. In some embodiments, the bacterial host cells are *Escherichia coli* cells. In some embodiments, the eukaryotic cells are yeast, plant (e.g. tobacco), insect (e.g. *Spodoptera frugiperda* sf9 cells), mouse, rat, hamster, guinea pig, non-human primate, or human cells. In some embodiments, the eukaryotic host cells are mammalian cells, including, but not limited to HEK293 cells, HEK293T cells, HEK293-F cells, Lenti-X 293T cells, BHK cells, HepG2 cells, Saos-2 cells, HuH7 cells, A549 cells, NS0 cells, SP2/0 cells, YO myeloma cells, P3X63 mouse myeloma cells, PER cells, PER.C6 cells, hybridoma cells, VERO cells, NIH3T3 cells, COS, W138 cells, MRC5 cells, HeLa, HT1080 cells, or CHO cells.

In some embodiments, improved yield of the CasX variant protein is achieved through codon optimization. Cells use 64 different codons, 61 of which encode the 20 standard amino acids, while another 3 function as stop codons. In some cases, a single amino acid is encoded by more than one codon. Different organisms exhibit bias towards use of different codons for the same naturally occurring amino acid. Therefore, the choice of codons in a protein, and matching codon choice to the organism in which the protein will be expressed, can, in some cases, significantly affect protein translation and therefore protein expression levels. In some embodiments, the CasX variant protein is encoded by a nucleic acid that has been codon optimized. In some embodiments, the nucleic acid encoding the CasX variant protein has been codon optimized for expression in a bacterial cell, a yeast cell, an insect cell, a plant cell, or a mammalian cell. In some embodiments, the mammal cell is a mouse, a rat, a hamster, a guinea pig, a monkey, or a human. In some embodiments, the CasX variant protein is encoded by a nucleic acid that has been codon optimized for expression in a human cell. In some embodiments, the CasX variant protein is encoded by a nucleic acid from which nucleotide sequences that reduce translation rates in prokaryotes and eukaryotes have been removed. For example, runs of greater than three thymine residues in a row can reduce translation rates in certain organisms or internal polyadenylation signals can reduce translation.

In some embodiments, improvements in solubility and stability, as described herein, result in improved yield of the CasX variant protein relative to a reference CasX protein.

Improved protein yield during expression and purification can be evaluated by methods known in the art. For example, the amount of CasX variant protein can be determined by running the protein on an SDS-page gel, and comparing the CasX variant protein to a control whose amount or concentration is known in advance to determine an absolute level of protein. Alternatively, or in addition, a purified CasX variant protein can be run on an SDS-page gel next to a reference CasX protein undergoing the same purification process to determine relative improvements in CasX variant protein yield. Alternatively, or in addition, levels of protein can be measured using immunohistochemical methods such as Western blot or ELISA with an antibody to CasX, or by HPLC. For proteins in solution, concentration can be determined by measuring of the protein's intrinsic UV absorbance, or by methods which use protein-dependent color changes such as the Lowry assay, the Smith copper/bicinchoninic assay or the Bradford dye assay. Such methods can be used to calculate the total protein (such as, for example, total soluble protein) yield obtained by expression under certain conditions. This can be compared, for example, to the protein yield of a reference CasX protein under similar expression conditions.

l. Protein Solubility

In some embodiments, a CasX variant protein has improved solubility relative to a reference CasX protein. In some embodiments, a CasX variant protein has improved solubility of the CasX:gNA ribonucleoprotein complex variant relative to a ribonucleoprotein complex comprising a reference CasX protein.

In some embodiments, an improvement in protein solubility leads to higher yield of protein from protein purification techniques such as purification from E. coli. Improved solubility of CasX variant proteins may, in some embodiments, enable more efficient activity in cells, as a more soluble protein may be less likely to aggregate in cells. Protein aggregates can in certain embodiments be toxic or burdensome on cells, and, without wishing to be bound by any theory, increased solubility of a CasX variant protein may ameliorate this result of protein aggregation. Further, improved solubility of CasX variant proteins may allow for enhanced formulations permitting the delivery of a higher effective dose of functional protein, for example in a desired gene editing application. In some embodiments, improved solubility of a CasX variant protein relative to a reference CasX protein results in improved yield of the CasX variant protein during purification of at least about 5, at least about 10, at least about 20, at least about 30, at least about 40, at least about 50, at least about 60, at least about 70, at least about 80, at least about 90, at least about 100, at least about 250, at least about 500, or at least about 1000-fold greater yield. In some embodiments, improved solubility of a CasX variant protein relative to a reference CasX protein improves activity of the CasX variant protein in cells by at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, at least about 15-fold, or at least about 20-fold greater activity.

Methods of measuring CasX protein solubility, and improvements thereof in CasX variant proteins, will be readily apparent to the person of ordinary skill in the art. For example, CasX variant protein solubility can in some embodiments be measured by taking densitometry readings on a gel of the soluble fraction of lysed E. coli. Alternatively, or addition, improvements in CasX variant protein solubility can be measured by measuring the maintenance of soluble protein product through the course of a full protein purification, including the methods of the Examples. For example, soluble protein product can be measured at one or more steps of gel affinity purification, tag cleavage, cation exchange purification, running the protein on a size exclusion chromatography (SEC) column. In some embodiments, the densitometry of every band of protein on a gel is read after each step in the purification process. CasX variant proteins with improved solubility may, in some embodiments, maintain a higher concentration at one or more steps in the protein purification process when compared to the reference CasX protein, while an insoluble protein variant may be lost at one or more steps due to buffer exchanges, filtration steps, interactions with a purification column, and the like.

In some embodiments, improving the solubility of CasX variant proteins results in a higher yield in terms of mg/L of protein during protein purification when compared to a reference CasX protein.

In some embodiments, improving the solubility of CasX variant proteins enables a greater amount of editing events compared to a less soluble protein when assessed in editing assays such as the EGFP disruption assays described herein.

m. Affinity for the gNA

In some embodiments, a CasX variant protein has improved affinity for the gNA relative to a reference CasX protein, leading to the formation of the ribonucleoprotein complex. Increased affinity of the CasX variant protein for the gNA may, for example, result in a lower $K_d$ for the generation of a RNP complex, which can, in some cases, result in a more stable ribonucleoprotein complex formation. In some embodiments, the $K_d$ of a CasX variant protein for a gNA is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant has about 1.1 to about 10-fold increased binding affinity to the gNA compared to the reference CasX protein of SEQ ID NO: 2.

In some embodiments, increased affinity of the CasX variant protein for the gNA results in increased stability of the ribonucleoprotein complex when delivered to mammalian cells, including in vivo delivery to a subject. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the ribonucleoprotein complex, allows for a lower dose of the CasX variant protein to be delivered to the subject or cells while still having the desired activity; for example in vivo or in vitro gene editing. The increased ability to form RNP and keep them in stable form can be assessed using assays such as the in vitro cleavage assays described herein. In some embodiments, the CasX variants of the disclosure are able to achieve a $K_{cleave}$ rate when complexed as an RNP that is at last 2-fold, at least 5-fold, or at least 10-fold higher compared to RNP of reference CasX.

In some embodiments, a higher affinity (tighter binding) of a CasX variant protein to a gNA allows for a greater amount of editing events when both the CasX variant protein and the gNA remain in an RNP complex. Increased editing events can be assessed using editing assays such as the EGFP disruption and in vitro cleavage assays described herein.

Without wishing to be bound by theory, in some embodiments amino acid changes in the helical I domain can increase the binding affinity of the CasX variant protein with the gNA targeting sequence, while changes in the helical II domain can increase the binding affinity of the CasX variant protein with the gNA scaffold stem loop, and changes in the oligonucleotide binding domain (OBD) increase the binding affinity of the CasX variant protein with the gNA triplex.

Methods of measuring CasX protein binding affinity for a gNA include in vitro methods using purified CasX protein and gNA. The binding affinity for reference CasX and variant proteins can be measured by fluorescence polarization if the gNA or CasX protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference CasX and variant proteins of the disclosure for specific gNAs such as reference gNAs and variants thereof include, but are not limited to, isothermal calorimetry (ITC), and surface plasmon resonance (SPR), as well as the methods of the Examples.

n. Affinity for Target Nucleic Acid

In some embodiments, a CasX variant protein has improved binding affinity for a target nucleic acid relative to the affinity of a reference CasX protein for a target nucleic acid. CasX variants with higher affinity for their target nucleic acid may, in some embodiments, cleave the target nucleic acid sequence more rapidly than a reference CasX protein that does not have increased affinity for the target nucleic acid.

In some embodiments, the improved affinity for the target nucleic acid comprises improved affinity for the target sequence or protospacer sequence of the target nucleic acid, improved affinity for the PAM sequence, an improved ability to search DNA for the target sequence, or any combinations thereof. Without wishing to be bound by theory, it is thought that CRISPR/Cas system proteins such as CasX may find their target sequences by one-dimension diffusion along a DNA molecule. The process is thought to include (1) binding of the ribonucleoprotein to the DNA molecule followed by (2) stalling at the target sequence, either of which may be, in some embodiments, affected by improved affinity of CasX proteins for a target nucleic acid sequence, thereby improving function of the CasX variant protein compared to a reference CasX protein.

In some embodiments, a CasX variant protein with improved target nucleic acid affinity has increased overall affinity for DNA. In some embodiments, a CasX variant protein with improved target nucleic acid affinity has increased affinity for or the ability to utilize specific PAM sequences other than the canonical TTC PAM recognized by the reference CasX protein of SEQ ID NO: 2, including PAM sequences selected from the group consisting of TTC, ATC, GTC, and CTC, thereby increasing the amount of target DNA that can be edited compared to wild-type CasX nucleases. Without wishing to be bound by theory, it is possible that these protein variants may interact more strongly with DNA overall and may have an increased ability to access and edit sequences within the target DNA due to the ability to utilize additional PAM sequences beyond those of wild-type reference CasX, thereby allowing for a more efficient search process of the CasX protein for the target sequence. A higher overall affinity for DNA also, in some embodiments, can increase the frequency at which a CasX protein can effectively start and finish a binding and unwinding step, thereby facilitating target strand invasion and R-loop formation, and ultimately the cleavage of a target nucleic acid sequence.

Without wishing to be bound by theory, it is possible that amino acid changes in the NTSBD that increase the efficiency of unwinding, or capture, of a non-target DNA strand in the unwound state, can increase the affinity of CasX variant proteins for target DNA. Alternatively, or in addition, amino acid changes in the NTSBD that increase the ability of the NTSBD to stabilize DNA during unwinding can increase the affinity of CasX variant proteins for target DNA. Alternatively, or in addition, amino acid changes in the OBD may increase the affinity of CasX variant protein binding to the protospacer adjacent motif (PAM), thereby increasing affinity of the CasX variant protein for target nucleic acid. Alternatively, or in addition, amino acid changes in the Helical I and/or II, RuvC and TSL domains that increase the affinity of the CasX variant protein for the target nucleic acid strand can increase the affinity of the CasX variant protein for target nucleic acid.

In some embodiments, binding affinity of a CasX variant protein of the disclosure for a target nucleic acid molecule is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant protein has about 1.1 to about 100-fold increased binding affinity to the target nucleic acid compared to the reference protein of SEQ ID NO: 1, SEQ ID NO: 2, or SEQ ID NO: 3.

In some embodiments, a CasX variant protein has improved binding affinity for the non-target strand of the target nucleic acid. As used herein, the term "non-target strand" refers to the strand of the DNA target nucleic acid sequence that does not form Watson and Crick base pairs with the targeting sequence in the gNA, and is complementary to the target DNA strand. In some embodiments, the CasX variant protein has about 1.1 to about 100-fold increased binding affinity to the non-target stand of the target nucleic acid compared to the reference protein of SEQ ID NO: 1, SEQ ID NO: 2, or SEQ ID NO: 3.

Methods of measuring CasX protein (such as reference or variant) affinity for a target and/or non-target nucleic acid molecule may include electrophoretic mobility shift assays (EMSAs), filter binding, isothermal calorimetry (ITC), and surface plasmon resonance (SPR), fluorescence polarization and biolayer interferometry (BLI). Further methods of measuring CasX protein affinity for a target include in vitro biochemical assays that measure DNA cleavage events over time.

o. Improved Specificity for a Target Site

In some embodiments, a CasX variant protein has improved specificity for a target nucleic acid sequence relative to a reference CasX protein. As used herein, "specificity," sometimes referred to as "target specificity," refers to the degree to which a CRISPR/Cas system ribonucleoprotein complex cleaves off-target sequences that are similar, but not identical to the target nucleic acid sequence; e.g., a CasX variant RNP with a higher degree of specificity would exhibit reduced off-target cleavage of sequences relative to a reference CasX protein. The specificity, and the reduction of potentially deleterious off-target effects, of CRISPR/Cas system proteins can be vitally important in order to achieve an acceptable therapeutic index for use in mammalian subjects.

In some embodiments, a CasX variant protein has improved specificity for a target site within the target sequence that is complementary to the targeting sequence of the gNA. Without wishing to be bound by theory, it is possible that amino acid changes in the helical I and II domains that increase the specificity of the CasX variant protein for the target nucleic acid strand can increase the specificity of the CasX variant protein for the target nucleic acid overall. In some embodiments, amino acid changes that increase specificity of CasX variant proteins for target nucleic acid may also result in decreased affinity of CasX variant proteins for DNA.

Methods of testing CasX protein (such as variant or reference) target specificity may include guide and Circularization for In vitro Reporting of Cleavage Effects by Sequencing (CIRCLE-seq), or similar methods. In brief, in CIRCLE-seq techniques, genomic DNA is sheared and circularized by ligation of stem-loop adapters, which are nicked in the stem-loop regions to expose 4 nucleotide palindromic overhangs. This is followed by intramolecular ligation and degradation of remaining linear DNA. Circular DNA molecules containing a CasX cleavage site are subsequently linearized with CasX, and adapter adapters are ligated to the exposed ends followed by high-throughput sequencing to generate paired end reads that contain information about the off-target site. Additional assays that can be used to detect off-target events, and therefore CasX protein specificity include assays used to detect and quantify indels (insertions and deletions) formed at those selected off-target sites such as mismatch-detection nuclease assays and next generation sequencing (NGS). Exemplary mismatch-detection assays include nuclease assays, in which genomic DNA from cells treated with CasX and sgNA is PCR amplified, denatured and rehybridized to form hetero-duplex DNA, containing one wild type strand and one strand with an indel. Mismatches are recognized and cleaved by mismatch detection nucleases, such as Surveyor nuclease or T7 endonuclease I.

p. Protospacer and PAM Sequences

Herein, the protospacer is defined as the DNA sequence complementary to the targeting sequence of the guide RNA and the DNA complementary to that sequence, referred to as the target strand and non-target strand, respectively. As used herein, the PAM is a nucleotide sequence proximal to the protospacer that, in conjunction with the targeting sequence of the gNA, helps the orientation and positioning of the CasX for the potential cleavage of the protospacer strand(s). PAM sequences may be degenerate, and specific RNP constructs may have different preferred and tolerated PAM sequences that support different efficiencies of cleavage. Following convention, unless stated otherwise, the disclosure refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target cleavage, or it may be some combination of nucleotides from both strands. In the case of the CasX proteins disclosed herein, the PAM is located 5' of the protospacer with a single nucleotide separating the PAM from the first nucleotide of the protospacer. Thus, in the case of reference CasX, a TTC PAM should be understood to mean a sequence following the formula 5'- . . . NNTTCN(protospacer)NNNNNN . . . 3' (SEQ ID NO: 3296) where 'N' is any DNA nucleotide and '(protospacer)' is a DNA sequence having identity with the targeting sequence of the guide RNA. In the case of a CasX variant with expanded PAM recognition, a TTC, CTC, GTC, or ATC PAM should be understood to mean a sequence following the formulae: 5'- . . . NNTTCN(protospacer) NNNNNN . . . 3' (SEQ ID NO: 3296); 5'- . . . NNCTCN (protospacer)NNNNNN . . . 3' (SEQ ID NO: 3297); 5'- . . . NNGTCN(protospacer)NNNNNN . . . 3' (SEQ ID NO: 3298); or 5'- . . . NNATCN(protospacer)NNNNNN . . . 3' (SEQ ID NO: 3299). Alternatively, a TC PAM should be understood to mean a sequence following the formula 5'- . . . NNNTCN(protospacer)NNNNNN . . . 3' (SEQ ID NO: 3300).

In some embodiments, a CasX variant has improved editing of a PAM sequence exhibits greater editing efficiency and/or binding of a target sequence in the target DNA when any one of the PAM sequences TTC, ATC, GTC, or CTC is located 1 nucleotide 5' to the non-target strand of the protospacer having identity with the targeting sequence of the gNA in a cellular assay system compared to the editing efficiency and/or binding of an RNP comprising a reference CasX protein in a comparable assay system. In some embodiments, the PAM sequence is TTC. In some embodiments, the PAM sequence is ATC. In some embodiments, the PAM sequence is CTC. In some embodiments, the PAM sequence is GTC.

q. Unwinding of DNA

In some embodiments, a CasX variant protein has improved ability to unwind DNA relative to a reference CasX protein. Poor dsDNA unwinding has been shown previously to impair or prevent the ability of CRISPR/Cas system proteins AnaCas9 or Cas14s to cleave DNA. Therefore, without wishing to be bound by any theory, it is likely that increased DNA cleavage activity by some CasX variant proteins of the disclosure is due, at least in part, to an increased ability to find and unwind the dsDNA at a target site. Methods of measuring the ability of CasX proteins (such as variant or reference) to unwind DNA include, but are not limited to, in vitro assays that observe increased on rates of dsDNA targets in fluorescence polarization or biolayer interferometry.

Without wishing to be bound by theory, it is thought that amino acid changes in the NTSB domain may produce CasX variant proteins with increased DNA unwinding characteristics. Alternatively, or in addition, amino acid changes in the OBD or the helical domain regions that interact with the PAM may also produce CasX variant proteins with increased DNA unwinding characteristics.

r. Catalytic Activity

The ribonucleoprotein complex of the CasX:gNA systems disclosed herein comprise a reference CasX protein or CasX variant complexed with a gNA that binds to a target nucleic acid and, in some cases, cleaves the target nucleic acid. In some embodiments, a CasX variant protein has improved catalytic activity relative to a reference CasX protein. Without wishing to be bound by theory, it is thought that in some cases cleavage of the target strand can be a limiting factor for Cas12-like molecules in creating a dsDNA break. In some embodiments, CasX variant proteins improve bending of the target strand of DNA and cleavage of this strand, resulting in an improvement in the overall efficiency of dsDNA cleavage by the CasX ribonucleoprotein complex.

Figure 10:
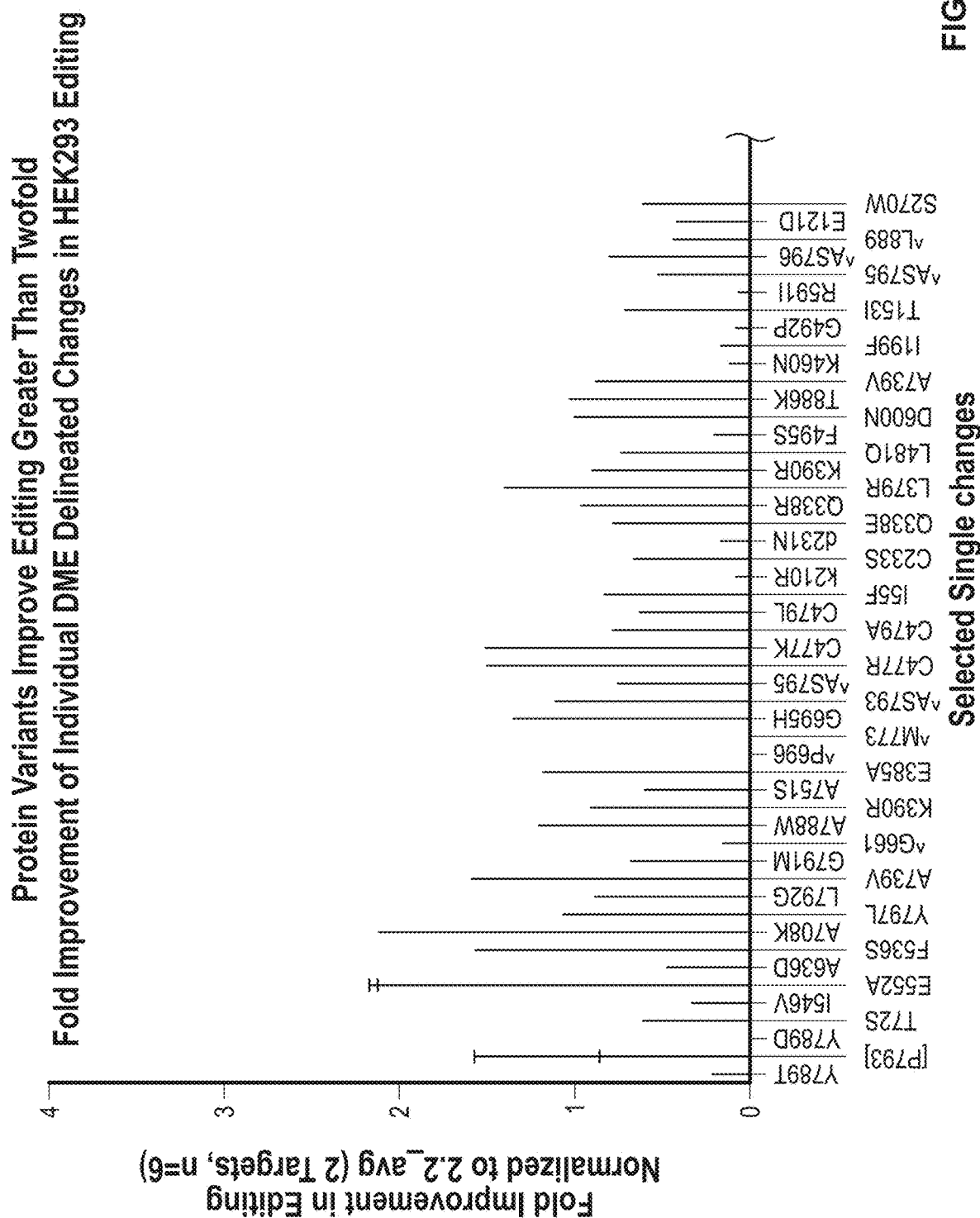
FIG. 10 is a plot showing that the evaluated CasX variant proteins improved editing greater than three-fold relative to a reference CasX protein in the EGFP disruption assay, as described in Example 5. CasX proteins were tested for their ability to cleave an EGFP reporter at 2 different target sites in human HEK293 cells, and the normalized improvement in genome editing at these sites over the basic reference CasX protein of SEQ ID NO: 2 is shown. Variants, from left to right (indicated by the amino acid substitution, insertion or deletion at the given residue number) are: Y789T, [P793], Y789D, T72S, I546V, E552A, A636D, F536S, A708K, Y797L, L792G, A739V, G791M, ^G661, A788W, K390R, A751S, E385A, ^P696, ^M773, G695H, ^AS793, ^AS795, C477R, C477K, C479A, C479L, I55F, K210R, C233S, D231N, Q338E, Q338R, L379R, K390R, L481Q, F495S, D600N, T886K, A739V, K460N, I199F, G492P, T153I, R591I, ^AS795, ^AS796, ^L889, E121D, S270W, E712Q, K942Q, E552K, K25Q, N47D, ^T696, L685I, N880D, Q102R, M734K, A724S, T704K, P224K, K25R, M29E, H152D, S219R, E475K, G226R, A377K, E480K, K416E, H164R, K767R, I7F, M29R, H435R, E385Q, E385K, I279F, D489S, D732N, A739T, W885R, E53K, A238T, P283Q, E292K, Q628E, R388Q, G791M, L792K, L792E, M779N, G27D, K955R, S867R, R693I, F189Y, V635M, F399L, E498K, E386S, V254G, P793S, K188E, QT945KI, T620P, T946P, TT949PP, N952T, K682E, K975R, L212P, E292R, I303K, C349E, E385P, E386N, D387K, L404K, E466H, C477Q, C477H, C479A, D659H, T806V, K808S, ^AS797, V959M, K975Q, W974G, A708Q, V711K, D733T, L742W, V747K, F755M, M771A, M771Q, W782Q, G791F, L792D, L792K, P793Q, P793G, Q804A, Y966N, Y723N, Y857R, S890R, S932M, L897M, R624G, S603G, N737S, L307K, 1658V ^PT688, ^SA794, S877R, N580T, V335G, T620S, W345G, T280S, L406P, A612D, A751S, E386R, V351M, K210N, D40A, E773G, H207L, T62A, T287P, T832A, A893S, ^V14, ^AG13, R11V, R12N, R13H, Y13, R12L, ^Q13, V15S, ^D17. ^ indicate insertions, [ ] indicate deletions.
Figure 10:
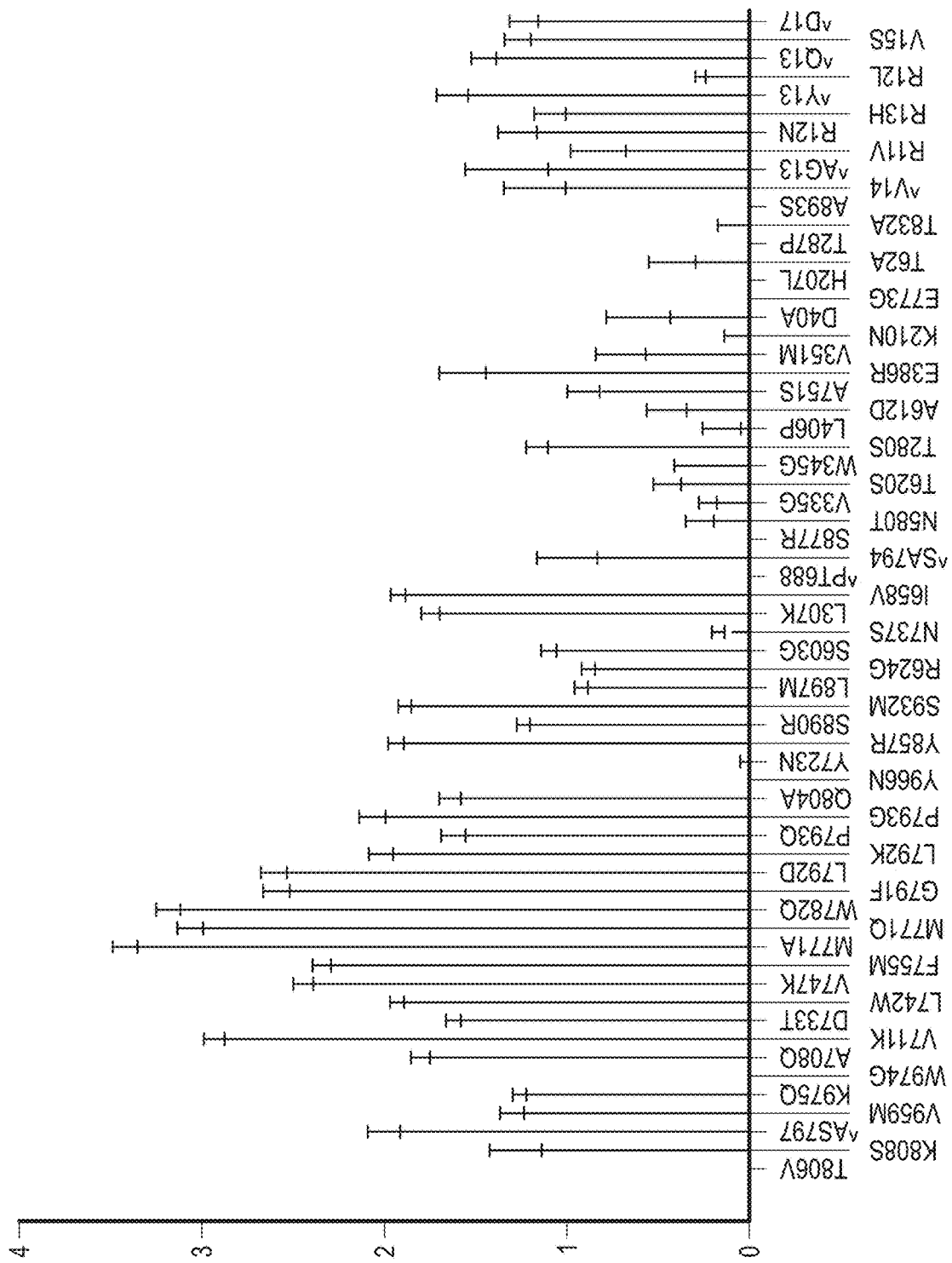

In some embodiments, a CasX variant protein has increased nuclease activity compared to a reference CasX protein. Variants with increased nuclease activity can be generated, for example, through amino acid changes in the RuvC nuclease domain. In some embodiments, amino acid substitutions in amino acid residues 708-804 of the RuvC domain can result in increased editing efficiency, as seen in FIG. 10. In some embodiments, the CasX variant comprises a nuclease domain having nickase activity. In the foregoing embodiment, the CasX nickase of a gene editing pair generates a single-stranded break within 10-18 nucleotides 3' of a PAM site in the non-target strand. In other embodiments, the CasX variant comprises a nuclease domain having double-stranded cleavage activity. In the foregoing, the CasX of the gene editing pair generates a double-stranded break within 18-26 nucleotides 5' of a PAM site on the target strand and 10-18 nucleotides 3' on the non-target strand. Nuclease activity can be assayed by a variety of methods, including those of the Examples. In some embodiments, a CasX variant has a $K_{cleave}$ constant that is at least 2-fold, or at least 3-fold, or at least 4-fold, or at least 5-fold, or at least 6-fold, or at least 7-fold, or at least 8-fold, or at least 9-fold, or at least 10-fold greater compared to a reference or wild-type CasX.

In some embodiments, a CasX variant protein has increased target strand loading for double strand cleavage. Variants with increased target strand loading activity can be generated, for example, through amino acid changes in the TLS domain. Without wishing to be bound by theory, amino acid changes in the TSL domain may result in CasX variant proteins with improved catalytic activity. Alternatively, or in addition, amino acid changes around the binding channel for the RNA:DNA duplex may also improve catalytic activity of the CasX variant protein.

In some embodiments, a CasX variant protein has increased collateral cleavage activity compared to a reference CasX protein. As used herein, "collateral cleavage activity" refers to additional, non-targeted cleavage of nucleic acids following recognition and cleavage of a target nucleic acid. In some embodiments, a CasX variant protein has decreased collateral cleavage activity compared to a reference CasX protein.

In some embodiments, for example those embodiments encompassing applications where cleavage of the target nucleic acid is not a desired outcome, improving the catalytic activity of a CasX variant protein comprises altering, reducing, or abolishing the catalytic activity of the CasX variant protein. In some embodiments, a ribonucleoprotein complex comprising a dCasX variant protein binds to a target nucleic acid and does not cleave the target nucleic acid.

In some embodiments, the CasX ribonucleoprotein complex comprising a CasX variant protein binds a target DNA but generates a single stranded nick in the target DNA. In some embodiments, particularly those embodiments wherein the CasX protein is a nickase, a CasX variant protein has decreased target strand loading for single strand nicking. Variants with decreased target strand loading may be generated, for example, through amino acid changes in the TSL domain.

Exemplary methods for characterizing the catalytic activity of CasX proteins may include, but are not limited to, in vitro cleavage assays, including those of the Examples, below. In some embodiments, electrophoresis of DNA products on agarose gels can interrogate the kinetics of strand cleavage.

s. Affinity for Target RNA

In some embodiments, a ribonucleoprotein complex comprising a reference CasX protein or variant thereof binds to a target RNA and cleaves the target nucleic acid. In some embodiments, variants of a reference CasX protein increase the specificity of the CasX variant protein for a target RNA, and increase the activity of the CasX variant protein with respect to a target RNA when compared to the reference CasX protein. For example, CasX variant proteins can display increased binding affinity for target RNAs, or increased cleavage of target RNAs, when compared to reference CasX proteins. In some embodiments, a ribonucleoprotein complex comprising a CasX variant protein binds to a target RNA and/or cleaves the target RNA. In some embodiments, a CasX variant has at least about two-fold to about 10-fold increased binding affinity to the target nucleic acid compared to the reference protein of SEQ ID NO: 1, SEQ ID NO: 2, or SEQ ID NO: 3.

t. CasX Fusion Proteins

In some embodiments, the disclosure provides CasX proteins comprising a heterologous protein fused to the CasX. In some cases, the CasX is a reference CasX protein. In other cases, the CasX is a CasX variant of any of the embodiments described herein.

In some embodiments, the CasX variant protein is fused to one or more proteins or domains thereof that have a different activity of interest, resulting in a fusion protein. For example, in some embodiments, the CasX variant protein is fused to a protein (or domain thereof) that inhibits transcription, modifies a target nucleic acid, or modifies a polypeptide associated with a nucleic acid (e.g., histone modification).

In some embodiments, a CasX variant comprises any one of SEQ ID NOS: 247-337, 3301-3493, 3498-3501, 3505-3520, 3540-3549 and 4412-4415 fused to one or more proteins or domains thereof with an activity of interest. In some embodiments, a CasX variant comprises any one of SEQ ID NOS: 247-337, 3498-3501, 3505-3520, 3540-3549 and 4412-4415 fused to one or more proteins or domains thereof with an activity of interest. In some embodiments, a CasX variant comprises any one of SEQ ID NOS: 3498-3501, 3505-3520, and 3540-3549 fused to one or more proteins or domains thereof with an activity of interest.

In some embodiments, a heterologous polypeptide (or heterologous amino acid such as a cysteine residue or a non-natural amino acid) can be inserted at one or more positions within a CasX protein to generate a CasX fusion protein. In other embodiments, a cysteine residue can be inserted at one or more positions within a CasX protein followed by conjugation of a heterologous polypeptide described below. In some alternative embodiments, a heterologous polypeptide or heterologous amino acid can be added at the N- or C-terminus of the reference or CasX variant protein. In other embodiments, a heterologous polypeptide or heterologous amino acid can be inserted internally within the sequence of the CasX protein.

In some embodiments, the reference CasX or variant fusion protein retains RNA-guided sequence specific target nucleic acid binding and cleavage activity. In some cases, the reference CasX or variant fusion protein has (retains) 50% or more of the activity (e.g., cleavage and/or binding activity) of the corresponding reference CasX or variant protein that does not have the insertion of the heterologous protein. In some cases, the reference CasX or variant fusion protein retains at least about 60%, or at least about 70%, at least about 80%, or at least about 90%, or at least about 92%, or at least about 95%, or at least about 98%, or about 100% of the activity (e.g., cleavage and/or binding activity) of the corresponding CasX protein that does not have the insertion of the heterologous protein.

In some cases, the reference CasX or CasX variant fusion protein retains (has) target nucleic acid binding activity relative to the activity of the CasX protein without the inserted heterologous amino acid or heterologous polypeptide. In some cases, the reference CasX or CasX variant fusion protein retains at least about 60%, or at least about 70%, at least about 80%, or at least about 90%, or at least about 92%, or at least about 95%, or at least about 98%, or about 100% of the binding activity of the corresponding CasX protein that does not have the insertion of the heterologous protein.

In some cases, the reference CasX or CasX variant fusion protein retains (has) target nucleic acid binding and/or cleavage activity relative to the activity of the parent CasX protein without the inserted heterologous amino acid or heterologous polypeptide. For example, in some cases, the reference CasX or CasX variant fusion protein has (retains) 50% or more of the binding and/or cleavage activity of the corresponding parent CasX protein (the CasX protein that does not have the insertion). For example, in some cases, the reference CasX or CasX variant fusion protein has (retains) 60% or more (70% or more, 80% or more, 90% or more, 92% or more, 95% or more, 98% or more, or 100%) of the binding and/or cleavage activity of the corresponding CasX parent protein (the CasX protein that does not have the insertion). Methods of measuring cleaving and/or binding activity of a CasX protein and/or a CasX fusion protein will be known to one of ordinary skill in the art, and any convenient method can be used.

A variety of heterologous polypeptides are suitable for inclusion in a reference CasX or CasX variant fusion protein of the disclosure. In some cases, the fusion partner can modulate transcription (e.g., inhibit transcription, increase transcription) of a target DNA. For example, in some cases the fusion partner is a protein (or a domain from a protein) that inhibits transcription (e.g., a transcriptional repressor, a protein that functions via recruitment of transcription inhibitor proteins, modification of target DNA such as methylation, recruitment of a DNA modifier, modulation of histones associated with target DNA, recruitment of a histone modifier such as those that modify acetylation and/or methylation of histones, and the like). In some cases the fusion partner is a protein (or a domain from a protein) that increases transcription (e.g., a transcription activator, a protein that acts via recruitment of transcription activator proteins, modification of target DNA such as demethylation, recruitment of a DNA modifier, modulation of histones associated with target DNA, recruitment of a histone modifier such as those that modify acetylation and/or methylation of histones, and the like).

In some cases, a fusion partner has enzymatic activity that modifies a target nucleic acid; e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity.

In some cases, a fusion partner has enzymatic activity that modifies a polypeptide (e.g., a histone) associated with a target nucleic acid; e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some embodiments, a CasX variant comprises any one of SEQ ID NOS: 247-337, 3301-3493, 3498-3501, 3505-3520, 3540-3549 and 4412-4415 and a polypeptide with methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some embodiments, a CasX variant comprises any one of SEQ ID NOS: 247-337, 3498-3501, 3505-3520, 3540-3549 and 4412-4415 and a polypeptide with methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some embodiments, a CasX variant comprises any one of SEQ ID NOS: 3498-3501, 3505-3520, and 3540-3549 and a polypeptide with methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity.

Examples of proteins (or fragments thereof) that can be used as a suitable fusion partner to a reference CasX or CasX variant to increase transcription include but are not limited to: transcriptional activators such as VP16, VP64, VP48, VP160, p65 subdomain (e.g., from NFkB), and activation domain of EDLL and/or transcription activator-like (TAL) activation domain (e.g., for activity in plants); histone lysine methyltransferases such as SET domain containing 1A, histone lysine methyltransferase (SET1A), SET domain containing 1B, histone lysine methyltransferase (SET1B), lysine methyltransferase 2A (MLL1) to 5, ASCL1 (ASH1)

achaete-scute family bHLH transcription factor 1 (ASH1), SET and MYND domain containing 2 provided (SMYD2), nuclear receptor binding SET domain protein 1 (NSD1), and the like; histone lysine demethylases such as lysine demethylase 3A (JHDM2a)/Lysine-specific demethylase 3B (JHDM2b), lysine demethylase 6A (UTX), lysine demethylase 6B (JMJD3), and the like; histone acetyltransferases such as lysine acetyltransferase 2A (GCN5), lysine acetyltransferase 2B (PCAF), CREB binding protein (CBP), E1A binding protein p30 (p300), TATA-box binding protein associated factor 1 (TAF1), lysine acetyltransferase 5 (TIP60/PLIP), lysine acetyltransferase 6A (MOZ/MYST3), lysine acetyltransferase 6B (MORF/MYST4), SRC proto-oncogene, non-receptor tyrosine kinase (SRC1), nuclear receptor coactivator 3 (ACTR), MYB binding protein 1a (P160), clock circadian regulator (CLOCK), and the like; and DNA demethylases such as Ten-Eleven Translocation (TET) dioxygenase 1 (TET1CD), tet methylcytosine dioxygenase 1 (TET1), demeter (DME), demeter-like 1 (DML1), demeter-like 2 (DML2), protein ROS1 (ROS1), and the like.

Examples of proteins (or fragments thereof) that can be used as a suitable fusion partner with a reference CasX or CasX variant to decrease transcription include but are not limited to: transcriptional repressors such as the Kruppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as PR/SET domain containing protein (Pr-SET)7/8, lysine methyltransferase 5B (SUV4- 20H1), PR/SET domain 2 (RIZ1), and the like; histone lysine demethylases such as lysine demethylase 4A (JMJD2A/JHDM3A), lysine demethylase 4B (JMJD2B), lysine demethylase 4C (JMJD2C/GASC1), lysine demethylase 4D (JMJD2D), lysine demethylase 5A (JARID1A/RBP2), lysine demethylase 5B (JARID1B/PLU-1), lysine demethylase 5C (JARID 1C/SMCX), lysine demethylase 5D (JARIDID/SMCY), and the like; histone lysine deacetylases such as histone deacetylase 1 (HDAC1), HDAC2, HDAC3, HDAC8, HDAC4, HDAC5, HDAC7, HDAC9, sirtuin 1 (SIRT1), SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), methyltransferase 1 (MET1), S-adenosyl-L-methionine-dependent methyltransferases superfamily protein (DRM3) (plants), DNA cytosine methyltransferase MET2a (ZMET2), chromomethylase 1 (CMT1), chromomethylase 2 (CMT2) (plants), and the like; and periphery recruitment elements such as Lamin A, Lamin B, and the like.

In some cases, the fusion partner to a reference CasX or CasX variant has enzymatic activity that modifies the target nucleic acid (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), MET1, DRM3 (plants), ZMET2, CMT1, CMT2 (plants), and the like); demethylase activity such as that provided by a demethylase (e.g., Ten-Eleven Translocation (TET) dioxygenase 1 (TET 1 CD), TET1, DME, DML1, DML2, ROS1, and the like), DNA repair activity, DNA damage activity, deamination activity such as that provided by a deaminase (e.g., a cytosine deaminase enzyme, e.g., an APOBEC protein such as rat apolipoprotein B mRNA editing enzyme, catalytic polypeptide 1 {APOBEC1}), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases, a reference CasX or CasX variant protein of the present disclosure is fused to a polypeptide selected from: a domain for increasing transcription (e.g., a VP16 domain, a VP64 domain), a domain for decreasing transcription (e.g., a KRAB domain, e.g., from the Kox1 protein), a core catalytic domain of a histone acetyltransferase (e.g., histone acetyltransferase p300), a protein/domain that provides a detectable signal (e.g., a fluorescent protein such as GFP), a nuclease domain (e.g., a FokI nuclease), and a base editor (discussed further below).

In some embodiments, a CasX variant comprises any one of SEQ ID NOS: 247-337, 3301-3493, 3498-3501, 3505-3520, 3540-3549 and 4412-4415 fused to a polypeptide selected from the group consisting of a domain for decreasing transcription, a domain with enzymatic activity, a core catalytic domain of a histone acetyltransferase, a protein/domain that provides a detectable signal, a nuclease domain, and a base editor. In some embodiments, a CasX variant comprises any one of SEQ ID NOS: 247-337, 3498-3501, 3505-3520, 3540-3549 and 4412-4415 fused to a polypeptide selected from the group consisting of a domain for decreasing transcription, a domain with enzymatic activity, a core catalytic domain of a histone acetyltransferase, a protein/domain that provides a detectable signal, a nuclease domain, and a base editor. In some embodiments, a CasX variant comprises any one of SEQ ID NOS: 3498-3501, 3505-3520, and 3540-3549 fused to a polypeptide selected from the group consisting of a domain for decreasing transcription, a domain with enzymatic activity, a core catalytic domain of a histone acetyltransferase, a protein/domain that provides a detectable signal, a nuclease domain, and a base editor.

In some cases, a reference CasX protein or CasX variant of the present disclosure is fused to a base editor. Base editors include those that can alter a guanine, adenine, cytosine, thymine, or uracil base on a nucleoside or nucleotide. Base editors include, but are not limited to an adenosine deaminase, cytosine deaminase (e.g. APOBEC1), and guanine oxidase. Accordingly, any of the reference CasX or CasX variants provided herein may comprise (i.e., are fused to) a base editor; for example a reference CasX or CasX variant of the disclosure may be fused to an adenosine deaminase, a cytosine deaminase, or a guanine oxidase. In exemplary embodiments, a CasX variant of the disclosure comprising any one of SEQ ID NOS: 247-337, 3301-3493, 3498-3501, 3505-3520, 3540-3549 and 4412-4415 is fused to an adenosine deaminase, cytosine deaminase, or a guanine oxidase.

In some cases, the fusion partner to a reference CasX or CasX variant has enzymatic activity that modifies a protein associated with the target nucleic acid (e.g., ssRNA, dsRNA, ssDNA, dsDNA) (e.g., a histone, an RNA binding protein, a DNA binding protein, and the like). Examples of enzymatic activity (that modifies a protein associated with a target nucleic acid) that can be provided by the fusion partner with a reference CasX or CasX variant include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB 1, and the like, SET1A, SET1B, MLL1 to 5, ASH1, SMYD2, NSD1, DOT1 like histone lysine methyltransferase (DOT1L), Pr-SET7/8, lysine methyltransferase 5B (SUV4-20H1), enhancer of zeste 2 polycomb repressive complex 2 subunit (EZH2), PR/SET domain 2 (RIZ1), demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HB01/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

Additional examples of suitable fusion partners to a reference CasX or CasX variant are (i) a dihydrofolate reductase (DHFR) destabilization domain (e.g., to generate a chemically controllable subject RNA-guided polypeptide), and (ii) a chloroplast transit peptide.

Suitable chloroplast transit peptides include, but are not limited to sequences having at least 80%, at least 90%, or at least 95% identity to or are identical to: MASMISSSAVTTVSRASRGQSAAMAPFGGLKSMTGFPVRK-VNTDITSITSNGGR VKCMQVWPPIGKKKFETLSYLP-PLTRDSRA (SEQ ID NO: 338); MASMISS-SAVTTVSRASRGQSAAMAPFGGLKSMTGFPVRKVN-TDITSITSNGGRVKS (SEQ ID NO: 339); MASSMLS-SATMVASPAQATMVAPFNGLKSSAAFPATRKANN-DITSITSNGGRVNCM QV WPPIEKKKFETLSYLPD-LTDSGGRVNC (SEQ ID NO: 340); MAQVSRICNGVQ-NPSLISNLSKSSQRKSPLSVSLKTQQHPRAYPISSS-WGLKKSGMTL IG SELRPLKVMSSVSTAC (SEQ ID NO: 341); MAQVSRICNGVWNPSLISNLSKSSQRK-SPLSVSLKTQQHPRAYPISSSWGLKKSGMTL IG SELRPLKVMSSVSTAC (SEQ ID NO: 342); MAQINN-MAQGIQTLNPNSNFHKPQVPKSSSFLVFGSKKLKN-SANSMLVLKKDSIFMQ LF CSFRISASVATAC (SEQ ID NO: 343); MAALVTSQLATSGTVLSVTDRFRRPGFQG-LRPRNPADAALGMRTVGASAAPKQSRK PH RFDRR-CLSMVV (SEQ ID NO: 344); MAALTTSQLATSATGF-GIADRSAPSSLLRHGFQGLKPRSPAGGDATSLSVTT-SARATP KQ QRSVQRGSRRFPSVVVC (SEQ ID NO: 345); MASSVLSSAAVATRSNVAQANMVAPFTGLKS-AASFPVSRKQNLDITSIASNGGRVQC (SEQ ID NO: 346); MESLAATSVFAPSRVAVPAARALVRAGTVVP-TRRTSSTSGTSGVKCSAAVTPQASPV IS RSAAAA (SEQ ID NO: 347); and MGAAATSMQSLKFSN-RLVPPSRRLSPVPNNVTCNNLPKSAAPVRTVKC-CASSWNSTI NGAAATTNGASAASS (SEQ ID NO: 348). In some embodiments, a CasX variant comprises any one of SEQ ID NOS: 247-337, 3301-3493, 3498-3501, 3505-3520, 3540-3549 and 4412-4415 and a chloroplast transit peptide. In some embodiments, a CasX variant comprises any one of SEQ ID NOS: 247-337, 3498-3501, 3505-3520, 3540-3549 and 4412-4415 and a chloroplast transit peptide. In some embodiments, a CasX variant comprises any one of SEQ ID NOS: 3498-3501, 3505-3520, and 3540-3549 and a chloroplast transit peptide.

In some cases, a reference CasX or CasX variant protein of the present disclosure can include an endosomal escape peptide. In some cases, an endosomal escape polypeptide comprises the amino acid sequence GLFX-ALLXLLXSLWXLLLXA (SEQ ID NO: 349), wherein each X is independently selected from lysine, histidine, and arginine. In some cases, an endosomal escape polypeptide comprises the amino acid sequence GLF-HALLHLLHSLWHLLLHA (SEQ ID NO: 350), or HHHHHHHHH (SEQ ID NO: 351). In some embodiments, a CasX variant comprises a sequence of any one of SEQ ID NOS: 247-337, 3301-3493, 3498-3501, 3505-3520, 3540-3549 and 4412-4415 and an endosomal escape polypeptide. In some embodiments, a CasX variant comprises a sequence of any one of SEQ ID NOS: 247-337, 3498-3501, 3505-3520, 3540-3549 and 4412-4415 and an endosomal escape polypeptide. In some embodiments, a CasX variant comprises a sequence of any one of SEQ ID NOS: 3498-3501, 3505-3520, and 3540-3549 and an endosomal escape polypeptide.

Non-limiting examples of suitable fusion partners for a reference CasX or CasX variant for use when targeting ssRNA target nucleic acids include (but are not limited to): splicing factors (e.g., RS domains); protein translation components (e.g., translation initiation, elongation, and/or release factors; e.g., eukaryotic translation initiation factor 4 gamma {eIF4G}); RNA methylases; RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or in some cases can include a fragment of the protein (e.g., a functional domain). In some embodiments, a CasX variant comprises any one of SEQ ID NOS: 247-337, 3301-3493, 3498-3501, 3505-3520, 3540-3549 and 4412-4415 and a protein or domain selected from the group consisting of a splicing factor, a protein translation component, an RNA methylase, an RNA editing enzyme, a helicase, and an RNA binding protein. In some embodiments, a CasX variant comprises any one of SEQ ID NOS: 247-337, 3498-3501, 3505-3520, 3540-3549 and 4412-4415 and a protein or domain selected from the group consisting of a splicing factor, a protein translation component, an RNA methylase, an RNA editing enzyme, a helicase, and an RNA binding protein. In some embodiments, a CasX variant comprises any one of SEQ ID NOS: 3498-3501, 3505-3520, and 3540-3549 and a protein or domain selected from the group consisting of a splicing factor, a protein translation component, an RNA methylase, an RNA editing enzyme, a helicase, and an RNA binding protein.

A fusion partner for a reference CasX or CasX variant can be any domain capable of interacting with ssRNA (which, for the purposes of this disclosure, includes intramolecular and/or intermolecular secondary structures, e.g., doublestranded RNA duplexes such as hairpins, stem-loops, etc.), whether transiently or irreversibly, directly or indirectly, including but not limited to an effector domain selected from the group comprising; endonucleases (for example RNase III, the CRR22 DYW domain, Dicer, and PIN (PilT N-terminus) domains from proteins such as SMG5 and SMG6); proteins and protein domains responsible for stimulating RNA cleavage (for example cleavage and polyadenylation specific factor {CPSF}, cleavage stimulation factor {CstF}, CFIm and CFIIm); exonucleases (for example chromatin-binding exonuclease XRN1 (XRN-1) or Exonuclease T); deadenylases (for example DNA 5'-adenosine monophosphate hydrolase {HNT3}); proteins and protein domains responsible for nonsense mediated RNA decay (for example UPF1 RNA helicase and ATPase {UPF1}, UPF2, UPF3, UPF3b, RNP SI, RNA binding motif protein 8A {Y14}, DEK proto-oncogene {DEK}, RNA-processing protein REF2 {REF2}, and Serine-arginine repetitive matrix 1 {SRm160}); proteins and protein domains responsible for stabilizing RNA (for example poly(A) binding protein cytoplasmic 1 {PABP}); proteins and protein domains responsible for repressing translation (for example argonaute RISC catalytic component 2 {Ago2} and Ago4); proteins and protein domains responsible for stimulating translation (for example Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example poly (A) polymerase (PAP1), PAP-associated domain-containing protein; Poly(A) RNA polymerase gld-2 {GLD-2}, and Star-PAP); proteins and protein domains responsible for polyuridinylation of RNA (for example Terminal uridylyltransferase {CID1} and terminal uridylate transferase); proteins and protein domains responsible for RNA localization (for example from insulin like growth factor 2 mRNA binding protein 1 {IMP1}, Z-DNA binding protein 1 {ZBP1}, She2p, She3p, and Bicaudal-D); proteins and protein domains responsible for nuclear retention of RNA (for example Rrp6); proteins and protein domains responsible for nuclear export of RNA (for example nuclear RNA export factor 1 {TAP}, nuclear RNA export factor 1 {NXF1}, THO Complex {THO}, TREX, REF, and Aly/REF export factor {Aly}); proteins and protein domains responsible for repression of RNA splicing (for example polypyrimidine tract binding protein 1 {PTB}, KH RNA binding domain containing, signal transduction associated 1 Sam68}, and heterogeneous nuclear ribonucleoprotein A1 {hnRNP A1}); proteins and protein domains responsible for stimulation of RNA splicing (for example serine/arginine-rich (SR) domains); proteins and protein domains responsible for reducing the efficiency of transcription (for example FUS RNA binding protein {FUS (TLS)}); and proteins and protein domains responsible for stimulating transcription (for example cyclin dependent kinase 7 {CDK7} and HIV Tat). Alternatively, the effector domain may be selected from the group comprising endonucleases; proteins and protein domains capable of stimulating RNA cleavage; exonucleases; deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable heterologous polypeptide is a PUF RNA-binding domain, which is described in more detail in WO2012068627, which is hereby incorporated by reference in its entirety.

Some suitable RNA splicing factors that can be used (in whole or as fragments thereof) as a fusion partner with a reference CasX or CasX variant have modular organization, with separate sequence-specific RNA binding modules and splicing effector domains. For example, members of the serine/arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal glycine-rich domain. Some splicing factors can regulate alternative use of splice site (ss) by binding to regulatory sequences between the two alternative sites. For example, ASF/SF2 can recognize ESEs and promote the use of intron proximal sites, whereas hnRNP A1 can bind to ESSs and shift splicing towards the use of intron distal sites. One application for such factors is to generate ESFs that modulate alternative splicing of endogenous genes, particularly disease associated genes. For example, BCL2 like 1 (Bcl-x) pre-mRNA produces two splicing isoforms with two alternative 5' splice sites to encode proteins of opposite functions. The long splicing isoform Bcl-xL is a potent apoptosis inhibitor expressed in long-lived post mitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cc-elements that are located in either the core exon region or the exon extension region (i.e., between the two alternative 5' splice sites). For more examples, see WO2010075303, which is hereby incorporated by reference in its entirety. Further suitable fusion partners include, but are not limited to proteins (or fragments thereof) that are boundary elements (e.g., CTCF), proteins and fragments thereof that provide periphery recruitment (e.g., Lamin A, Lamin B, etc.), and protein docking elements (e.g., FKBP/FRB, Pill/Abyl, etc.).

In some cases, a heterologous polypeptide (a fusion partner) for use with a reference CasX or CasX variant provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a subject RNA-guided polypeptide or a conditionally active RNA-guided polypeptide and/or subject CasX fusion protein does not include a NLS so that the protein is not targeted to the nucleus, which can be advantageous; e.g., when the target nucleic acid is an RNA that is present in the cytosol. In some embodiments, a fusion partner can provide a tag (i.e., the heterologous polypeptide is a detectable label) for ease of tracking and/or purification (e.g., a fluorescent protein, e.g., green fluorescent protein (GFP), yellow fluorescent protein (YFP), red fluorescent protein (RFP), cyan fluorescent protein (CFP), mCherry, tdTomato, and the like; a histidine tag, e.g., a 6×His tag; a hemagglutinin (HA) tag; a FLAG tag; a Myc tag; and the like). In some embodiments, a CasX variant comprises any one of SEQ ID NOS: 247-337, 3301-3493, 3498-3501, 3505-3520, 3540-3549 and 4412-4415 and a subcellular localization sequence or a tag. In some embodiments, a CasX variant comprises any one of SEQ ID NOS: 247-337, 3498-3501, 3505-3520, 3540-3549 and 4412-4415 and a subcellular localization sequence or a tag. In some embodiments, a CasX variant comprises any one of SEQ ID NOS: 3498-3501, 3505-3520, and 3540-3549 and a subcellular localization sequence or a tag.

In some cases, a reference or CasX variant protein includes (is fused to) a nuclear localization signal (NLS). In some cases, a reference or CasX variant protein is fused to 2 or more, 3 or more, 4 or more, or 5 or more 6 or more, 7 or more, 8 or more NLSs. In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus. In some cases, a reference or CasX variant protein includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases, a reference or CasX variant protein includes (is fused to) between 2 and 5 NLSs (e.g., 2-4, or 2-3 NLSs).

Non-limiting examples of NLSs suitable for use with a reference CasX or CasX variant include sequences having at least about 80%, at least about 90%, or at least about 95% identity or are identical to sequences derived from: the NLS of the SV40 virus large T-antigen, having the amino acid sequence PKKKRKV (SEQ ID NO: 352); the NLS from nucleoplasmin (e.g., the nucleoplasmin bipartite NLS with the sequence KRPAATKKAGQAKKKK (SEQ ID NO: 353); the c-myc NLS having the amino acid sequence PAAKRVKLD (SEQ ID NO: 354) or RQRRNELKRSP (SEQ ID NO: 355); the hRNPA1 M9 NLS having the sequence NQSSNFGPMKGGNFGGRSSGPYGGGG-QYFAKPRNQGGY (SEQ ID NO: 356); the sequence RMRIZFKNKGKDTAELRRRRVEVSVELRKAKKD-EQILKRRNV (SEQ ID NO: 357) of the IBB domain from importin-alpha; the sequences VSRKRPRP (SEQ ID NO: 358) and PPKKARED (SEQ ID NO: 359) of the myoma T protein; the sequence PQPKKKPL (SEQ ID NO: 360) of human p53; the sequence SALIKKKKKMAP (SEQ ID NO: 361) of mouse c-abl IV; the sequences DRLRR (SEQ ID NO: 362) and PKQKKRK (SEQ ID NO: 363) of the influenza virus NS1; the sequence RKLKKKIKKL (SEQ ID NO: 364) of the Hepatitis virus delta antigen; the sequence REKKKFLKRR (SEQ ID NO: 365) of the mouse Mx1 protein; the sequence KRKGDEVDGVDEVAKKKSKK (SEQ ID NO: 366) of the human poly(ADP-ribose) polymerase; the sequence RKCLQAGMNLEARKTKK (SEQ ID NO: 367) of the steroid hormone receptors (human) glucocorticoid; the sequence PRPRKIPR (SEQ ID NO: 368) of Borna disease virus P protein (BDV-P1); the sequence PPRKKRTVV (SEQ ID NO: 369) of hepatitis C virus nonstructural protein (HCV-NS5A); the sequence NLSKKKKRKREK (SEQ ID NO: 370) of LEF1; the sequence RRPSRPFRKP (SEQ ID NO: 371) of ORF57 simirae; the sequence KRPRSPSS (SEQ ID NO: 372) of EBV LANA; the sequence KRGINDRNFWRGENERKTR (SEQ ID NO: 373) of Influenza A protein; the sequence PRPPKMARYDN (SEQ ID NO: 374) of human RNA helicase A (RHA); the sequence KRSFSKAF (SEQ ID NO: 375) of nucleolar RNA helicase II; the sequence KLKIKRPVK (SEQ ID NO: 376) of TUS-protein; the sequence PKKKRKVPPPPAAKRVKLD (SEQ ID NO: 377) associated with importin-alpha; the sequence PKTRRR-PRRSQRKRPPT (SEQ ID NO: 378) from the Rex protein in HTLV-1; the sequence SRRR-KANPTKLSENAKKLAKEVEN (SEQ ID NO: 379) from the EGL-13 protein of *Caenorhabditis elegans*; and the sequences KTRRRPRRSQRKRPPT (SEQ ID NO: 380), RRKKRRPRRKKRR (SEQ ID NO: 381), PKKKSRKPKKKSRK (SEQ ID NO: 382), HKKKHP-DASVNFSEFSK (SEQ ID NO: 383), QRPGPY-DRPQRPGPYDRP (SEQ ID NO: 384), LSPSLSPLLSPSL-SPL (SEQ ID NO: 385), RGKGGKGLGKGGAKRHRK (SEQ ID NO: 386), PKRGRGRPKRGRGR (SEQ ID NO: 387), PKKKRKVPPPPAAKRVKLD (SEQ ID NO: 388) and PKKKRKVPPPPKKKRKV (SEQ ID NO: 389). In general, NLS (or multiple NLSs) are of sufficient strength to drive accumulation of a reference or CasX variant fusion protein in the nucleus of a eukaryotic cell. Detection of accumulation in the nucleus may be performed by any suitable technique. For example, a detectable marker may be fused to a reference or CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

In some embodiments, a CasX variant comprising an N terminal NLS comprises a sequence of any one of SEQ ID NOS: 3508-3540-3549. In some embodiments, a CasX variant comprising an N terminal NLS comprises a sequence with one or more additional modifications to of any one of SEQ ID NOS: 3508-3540-3549.

In some cases, a reference or CasX variant fusion protein includes a "Protein Transduction Domain" or PTD (also known as a CPP—cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a reference or CasX variant fusion protein. In some embodiments, a PTD is covalently linked to the carboxyl terminus of a reference or CasX variant fusion protein. In some cases, the PTD is inserted internally in the sequence of a reference or CasX variant fusion protein at a suitable insertion site. In some cases, a reference or CasX variant fusion protein includes (is conjugated to, is fused to) one or more PTDs (e.g., two or more, three or more, four or more PTDs). In some cases, a PTD includes one or more nuclear localization signals (NLS). Examples of PTDs include but are not limited to peptide transduction domain of HIV TAT comprising YGRKKRRQRRR (SEQ ID NO: 390), RKKRRQRR (SEQ ID NO: 391); YARAAARQARA (SEQ ID NO: 392); THRLPRRRRRR (SEQ ID NO: 393); and GGRRARRRRRR (SEQ ID NO: 394); a polyarginine sequence comprising a number of arginines sufficient to direct entry into a cell (e.g., 3, 4, 5, 6, 7, 8, 9, 10, or 10-50 arginines); a VP22 domain (Zender et al. (2002) Cancer Gene Ther. 9(6):489-96); an *Drosophila* Antennapedia protein transduction domain (Noguchi et al. (2003) Diabetes 52(7): 1732-1737); a truncated human calcitonin peptide (Trehin et al. (2004) Pharm. Research 21:1248-1256); polylysine (Wender et al. (2000) Proc. Natl. Acad. Sci. USA 97: 13003-13008); RRQRRTSKLMKR (SEQ ID NO: 395); Transportan GWTLNSAGYLLGKINLKALAALAKKIL (SEQ ID NO: 396); KALAWEAKLAKALAKA-LAKHLAKALAKALKCEA (SEQ ID NO: 397); and RQIKIWFQNRRMKWKK (SEQ ID NO: 398). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane. In some embodiments, a CasX variant comprises any one of SEQ ID NOS: 247-337, 3301-3493, 3498-3501, 3505-3520, 3540-3549 and 4412-4415 and a PTD. In some embodiments, a CasX variant comprises any one of SEQ ID NOS: 247-337, 3498-3501, 3505-3520, 3540-3549 and 4412-4415 and a PTD. In some embodiments, a CasX variant comprises any one of SEQ ID NOS: 3498-3501, 3505-3520, and 3540-3549 and a PTD.

In some embodiments, a reference or CasX variant fusion protein can include a CasX protein that is linked to an internally inserted heterologous amino acid or heterologous polypeptide (a heterologous amino acid sequence) via a linker polypeptide (e.g., one or more linker polypeptides). In some embodiments, a reference or CasX variant fusion protein can be linked at the C-terminal and/or N-terminal end to a heterologous polypeptide (fusion partner) via a linker polypeptide (e.g., one or more linker polypeptides) The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers are generally produced by using synthetic, linker-encoding oligonucleotides to couple the proteins. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use. Example linker polypeptides include glycine polymers (G)n, glycine-serine polymer (including, for example, (GS)n, GSGGSn (SEQ ID NO: 399), GGSGGSn (SEQ ID NO: 400), and GGGSn (SEQ ID NO: 401), where n is an integer of at least one), glycine-alanine polymers, alanine-serine polymers, glycine-proline polymers, proline polymers and proline-alanine polymers. Example linkers can comprise amino acid sequences including, but not limited to, GGSG (SEQ ID NO: 402), GGSGG (SEQ ID NO: 403), GSGSG (SEQ ID NO: 404), GSGGG (SEQ ID NO: 405), GGGSG (SEQ ID NO: 406), GSSSG (SEQ ID NO: 407), GPGP (SEQ ID NO: 408), GGP, PPP, PPAPPA (SEQ ID NO: 409), PPPGPPP (SEQ ID NO: 410) and the like. The ordinarily skilled artisan will recognize that design of a peptide conjugated to any elements described above can include linkers that are all or partially flexible, such that the linker can include a flexible linker as well as one or more portions that confer less flexible structure.

V. gNA and CasX Protein Gene Editing Pairs

In other aspects, provided herein are compositions of a gene editing pair comprising a CasX protein and a guide NA, referred to herein as a gene editing pair. In certain embodiments, the gene editing pair comprises a CasX variant protein as described herein (e.g., any one of the sequences set forth in Tables 3, 8, 9, 10 and 12) or a reference CasX protein as described herein (e.g., SEQ ID NOS:1-3), while, the guide NA is a reference gRNA (SEQ ID NOS: 4-16) or a gNA variant as described herein (e.g., SEQ ID NOS: 2101-2280), or sequence variants having at least 60%, or at least 70%, at least about 80%, or at least about 90%, or at least about 95% sequence identity thereto, wherein the gNA comprises a targeting sequence complementary to the target DNA. In those embodiments in which one component is a variant, the pair is referred to as a variant gene editing pair. In other embodiments, a gene editing pair comprises the CasX protein, a first gNA (either a reference gRNA {SEQ ID NOS: 4-16} or a gNA variant as described herein {e.g., SEQ ID NOS: 2101-2280}) with a targeting sequence, and a second gNA variant or a second reference guide nucleic acid, wherein the second gNA variant or the second reference guide nucleic acid has a targeting sequence complementary to a different or overlapping portion of the target DNA compared to the targeting sequence of the first gNA.

In some embodiments, the variant gene editing pair has one or more improved characteristics compared to a reference gene editing pair, wherein the reference gene editing pair comprises a CasX protein of SEQ ID NOS: 1-3, a different gNA, or both. For example, in some embodiments, the variant gene editing pair comprises a CasX variant protein, and the variant gene editing pair has one or more improved characteristics compared to a reference gene editing pair comprising a reference CasX protein. In other embodiments, the variant gene editing pair comprises a gNA variant, and the variant gene editing pair has one or more improved characteristics compared to a reference gene editing pair comprising a reference gRNA. In other embodiments, the variant gene editing pair comprises a gNA variant and a CasX variant protein, and the variant gene editing pair has one or more improved characteristics compared to a reference gene editing pair comprising a reference CasX protein and a reference gRNA.

In some embodiments of the variant gene editing pairs provided herein, the CasX is a variant protein as described herein (e.g., the sequences set forth in Tables 3, 8, 9, 10 and 12 or sequence variants having at least 60%, or at least 70%, at least about 80%, or at least about 90%, or at least about 95%, or at least about 99% sequence identity to the listed sequences) while the gNA is a reference gRNA of SEQ ID NO: 5 or SEQ ID NO: 4. In some embodiments of the variant gene editing pairs provided herein, the CasX comprises a reference CasX protein of SEQ ID NO: 1, SEQ ID NO: 2, or SEQ ID NO: 3 while the gNA variant is a sequence of SEQ ID NOS:2101-2280, or sequence variants having at least 60%, or at least 70%, at least about 80%, or at least about 90%, or at least about 95% sequence identity to the listed sequences.

In some embodiments, the variant gene editing pair has one or more improved characteristics compared to a reference gene editing pair comprising a reference CasX protein of SEQ ID NO: 1, SEQ ID NO: 2, or SEQ ID NO: 3. In some embodiments, the variant gene editing pair has one or more improved characteristics compared to a reference gene editing pair comprising a reference gRNA of SEQ ID NO: 5 or SEQ ID NO: 4. In some embodiments, the variant gene editing pair has one or more improved characteristics compared to a reference gene editing pair comprising a reference CasX protein of SEQ ID NO: 1, SEQ ID NO: 2, or SEQ ID NO: 3 and a reference gRNA of SEQ ID NO: 5 or SEQ ID NO: 4.

Exemplary improved characteristics, as described herein, may in some embodiments, and include improved CasX: gNA RNP complex stability, improved binding affinity between the CasX and gNA, improved kinetics of RNP complex formation, higher percentage of cleavage-competent RNP, improved RNP binding affinity to the target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, or improved resistance to nuclease activity. In the foregoing embodiments, the improvement is at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the characteristic of a reference CasX protein and reference gNA pair. In other cases, the one or more of the improved characteristics may be improved about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to a reference gene editing pair. In other cases, the one or more of the improved characteristics may be improved about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold or more improved relative to a reference gene editing pair.

In some embodiments, the variant gene editing pair comprises a gNA variant comprising a sequence of any one of SEQ ID NOs: 2101-2280 and a reference CasX protein comprising an amino acid sequence of SEQ ID NO: 1. In some embodiments, the variant gene editing pair comprises a gNA variant comprising a sequence of any one of SEQ ID NOS: 2101-2280 and a CasX variant protein comprising a variant of the reference CasX protein of SEQ ID NO: 2. In some embodiments, the variant gene editing pair comprises a reference gRNA comprising a sequence of SEQ ID NO: 5 or SEQ ID NO: 4 and a CasX variant protein comprising a variant of the reference CasX protein of SEQ ID NO: 2. In some embodiments, the CasX variant protein comprises a Y789T substitution of SEQ ID NO: 2; a deletion of P at position 793 of SEQ ID NO: 2, a Y789D substitution of SEQ ID NO: 2, a T72S substitution of SEQ ID NO: 2, a I546V substitution of SEQ ID NO: 2, a E552A substitution of SEQ ID NO: 2, a A636D substitution of SEQ ID NO: 2, a F536S substitution of SEQ ID NO: 2, a A708K substitution of SEQ ID NO: 2, a Y797L substitution of SEQ ID NO: 2, a L792G substitution of SEQ ID NO: 2, a A739V substitution of SEQ ID NO: 2, a G791M substitution of SEQ ID NO: 2, an insertion of A at position 661 of SEQ ID NO: 2, a A788W substitution of SEQ ID NO: 2, a K390R substitution of SEQ ID NO: 2, a A751S substitution of SEQ ID NO: 2, a E385A substitution of SEQ ID NO: 2, a combination of S794R and Y797L substitutions of SEQ ID NO: 2, an insertion of P at 696 of SEQ ID NO: 2, a combination of K416E and A708K substitutions of SEQ ID NO: 2, an insertion of M at position 773 of SEQ ID NO: 2, a G695H substitution of SEQ ID NO: 2, an insertion of AS at position 793 of SEQ ID NO: 2, an insertion of AS at position 795 of SEQ ID NO: 2, a C477R substitution of SEQ ID NO: 2, a C477K substitution of SEQ ID NO: 2, a C479A substitution of SEQ ID NO: 2, a C479L substitution of SEQ ID NO: 2, a combination of an A708K substitution and a deletion of P at position 793 of SEQ ID NO: 2, a I55F substitution of SEQ ID NO: 2, a K210R substitution of SEQ ID NO: 2, a C233S substitution of SEQ ID NO: 2, a D231N substitution of SEQ ID NO: 2, a Q338E substitution of SEQ ID NO: 2, a Q338R substitution of SEQ ID NO: 2, a L379R substitution of SEQ ID NO: 2, a K390R substitution of SEQ ID NO: 2, a L481Q substitution of SEQ ID NO: 2, a F495S substitution of SEQ ID NO: 2, a D600N substitution of SEQ ID NO: 2, a T886K substitution of SEQ ID NO: 2, a combination of a deletion of P at position 793] and a P793AS substitution of SEQ ID NO: 2, a A739V substitution of SEQ ID NO: 2, a K460N substitution of SEQ ID NO: 2, a I199F substitution of SEQ ID NO: 2, a G492P substitution of SEQ ID NO: 2, a T153I substitution of SEQ ID NO: 2, a R591I substitution of SEQ ID NO: 2, an insertion of AS at position 795 of SEQ ID NO: 2, an insertion of AS at position 796 of SEQ ID NO: 2, an insertion of L at position 889 of SEQ ID NO: 2, a E121D substitution of SEQ ID NO: 2, a S270W substitution of SEQ ID NO: 2, a E712Q substitution of SEQ ID NO: 2, a K942Q substitution of SEQ ID NO: 2, a E552K substitution of SEQ ID NO: 2, a K25Q substitution of SEQ ID NO: 2, a N47D substitution of SEQ ID NO: 2, a combination Q367K and I425S substitutions of SEQ ID NO: 2, an insertion of T at position 696 of SEQ ID NO: 2, a L685I substitution of SEQ ID NO: 2, a N880D substitution of SEQ ID NO: 2, a combination of a A708K substitution, a deletion of P at position 793 and a A739V substitution of SEQ ID NO: 2, a Q102R substitution of SEQ ID NO: 2, a M734K substitution of SEQ ID NO: 2, a A724S substitution of SEQ ID NO: 2, a T704K substitution of SEQ ID NO: 2, a P224K substitution of SEQ ID NO: 2, a combination of Q338R and A339E substitutions of SEQ ID NO: 2, a combination of Q338R and A339K substitutions of SEQ ID NO: 2, a K25R substitution of SEQ ID NO: 2, a M29E substitution of SEQ ID NO: 2, a H152D substitution of SEQ ID NO: 2, a S219R substitution of SEQ ID NO: 2, a E475K substitution of SEQ ID NO: 2, a combination of S507G and G508R substitutions of SEQ ID NO: 2, a g226R substitution of SEQ ID NO: 2, a A377K substitution of SEQ ID NO: 2, a E480K substitution of SEQ ID NO: 2, a K416E substitution of SEQ ID NO: 2, a H164R substitution of SEQ ID NO: 2, a K767R substitution of SEQ ID NO: 2, a I7F substitution of SEQ ID NO: 2, a m29R substitution of SEQ ID NO: 2, a H435R substitution of SEQ ID NO: 2, a E385Q substitution of SEQ ID NO: 2, a E385K substitution of SEQ ID NO: 2, a I279F substitution of SEQ ID NO: 2, a D489S substitution of SEQ ID NO: 2, a D732N substitution of SEQ ID NO: 2, a A739T substitution of SEQ ID NO: 2, a W885R substitution of SEQ ID NO: 2, a E53K substitution of SEQ ID NO: 2, a A238T substitution of SEQ ID NO: 2, a P283Q substitution of SEQ ID NO: 2, a E292K substitution of SEQ ID NO: 2, a Q628E substitution of SEQ ID NO: 2, a combination of F556I+D646A+G695D+A751S+A820P substitutions of SEQ ID NO: 2, a R388Q substitution of SEQ ID NO: 2, a combination of L491I and M771N substitutions of SEQ ID NO: 2, a G791M substitution of SEQ ID NO: 2, a L792K substitution of SEQ ID NO: 2, a L792E substitution of SEQ ID NO: 2, a M779N substitution of SEQ ID NO: 2, a G27D substitution of SEQ ID NO: 2, a combination of L379R and A708K substitutions and a deletion of P at position 793 of SEQ ID NO: 2, a combination of C477K and A708K substitutions and a deletion of P at position 793 of SEQ ID NO: 2, a combination of L379R, C477K and A708K substitutions and a deletion of P at position 793 of SEQ ID NO: 2, a combination of L379R, A708K and A739V substitutions and a deletion of P at position 793 of SEQ ID NO: 2, a combination of C477K, A708K and A739V substitutions and a deletion of P at position 793 of SEQ ID NO: 2, a combination of L379R, C477K, A708K and A739V substitutions and a deletion of P at position 793 of SEQ ID NO: 2, a K955R substitution of SEQ ID NO: 2, a S867R substitution of SEQ ID NO: 2, a R693I substitution of SEQ ID NO: 2, a F189Y substitution of SEQ ID NO: 2, a V635M substitution of SEQ ID NO: 2, a F399L substitution of SEQ ID NO: 2, a E498K substitution of SEQ ID NO: 2, a E386R substitution of SEQ ID NO: 2, a V254G substitution of SEQ ID NO: 2, a P793S substitution of SEQ ID NO: 2, a K188E substitution of SEQ ID NO: 2, a QT945KI substitution of SEQ ID NO: 2, a T620P substitution of SEQ ID NO: 2, a T946P substitution of SEQ ID NO: 2, a TT949PP substitution of SEQ ID NO: 2, a N952T substitution of SEQ ID NO: 2 or a K682E substitution of SEQ ID NO: 2.

In some embodiments, the variant gene editing pair comprises a CasX gRNA of SEQ ID NO: 5 and a CasX variant protein comprising a combination of L379R and A708K substitutions and a deletion of P at position 793 of SEQ ID NO: 2. In some embodiments, the variant gene editing pair comprises a reference CasX protein SEQ ID NO: 2 and sgNA scaffold variant of SEQ ID NO: 5.

In some embodiments of the sgNA: protein variant pairs of the disclosure, the CasX variant protein is selected from the group consisting of: a CasX variant protein comprising a substitution of L379R, a substitution of C477K, a substitution of A708K, a deletion of P at position 793 and a substitution of T620P of SEQ ID NO: 2; a CasX variant protein comprising a substitution of M771A of SEQ ID NO: 2; a CasX variant protein comprising a substitution of L379R, a substitution of A708K, a deletion of P at position 793 and a substitution of D732N of SEQ ID NO: 2; a CasX variant protein comprising a substitution of W782Q of SEQ ID NO: 2; a CasX variant protein comprising a substitution of M771Q of SEQ ID NO: 2; a CasX variant protein comprises a substitution of R458I and a substitution of A739V of SEQ ID NO: 2; a CasX variant protein comprising a substitution of L379R, a substitution of A708K, a deletion of P at position 793 and a substitution of M771N of SEQ ID NO: 2; a CasX variant protein comprising a substitution of L379R, a substitution of A708K, a deletion of P at position 793 and a substitution of A739T of SEQ ID NO: 2; a CasX variant protein comprising a substitution of L379R, a substitution of C477K, a substitution of A708K, a deletion of P at position 793 and a substitution of D489S of SEQ ID NO: 2; a CasX variant protein comprising a substitution of L379R, a substitution of C477K, a substitution of A708K, a deletion of P at position 793 and a substitution of D732N of SEQ ID NO: 2; a CasX variant protein comprising a substitution of V711K of SEQ ID NO: 2; a CasX variant protein comprising a substitution of L379R, a substitution of C477K, a substitution of A708K, a deletion of P at position 793 and a substitution of Y797L of SEQ ID NO: 2; a CasX variant protein comprising a substitution of L379R, a substitution of A708K and a deletion of P at position 793 of SEQ ID NO: 2; a CasX variant protein comprising a substitution of L379R, a substitution of C477K, a substitution of A708K, a deletion of P at position 793 and a substitution of M771N of SEQ ID NO: 2; a CasX variant protein comprising a substitution of A708K, a substitution of P at position 793 and a substitution of E386S of SEQ ID NO: 2; a CasX variant protein comprising a substitution of L379R, a substitution of C477K, a substitution of A708K and a deletion of P at position 793 of SEQ ID NO: 2; a CasX variant protein comprising a substitution of L792D of SEQ ID NO: 2; a CasX variant protein comprising a substitution of G791F of SEQ ID NO: 2; a CasX variant protein comprising a substitution of A708K, a deletion of P at position 793 and a substitution of A739V of SEQ ID NO: 2; a CasX variant protein comprising a substitution of L379, a substitution of A708K, a deletion of P at position 793 and a substitution of A739V of SEQ ID NO: 2; a CasX variant protein comprising a substitution of C477K, a substitution of A708K and a substitution of P at position 793 of SEQ ID NO: 2; a CasX variant protein comprising a substitution of L249I and a substitution of M771N of SEQ ID NO: 2; a CasX variant protein comprising a substitution of V747K of SEQ ID NO: 2; and a CasX variant protein comprises a substitution of L379R, a substitution of C477, a substitution of A708K, a deletion of P at position 793 and a substitution of M779N of SEQ ID NO: 2; and the sequence encoding the sgNA variant is selected from the group consisting of SEQ ID NO: 2104, SEQ ID NO: 2163, SEQ ID NO: 2107, SEQ ID NO: 2164, SEQ ID NO: 2165, SEQ ID NO: 2166, SEQ ID NO: 2103, SEQ ID NO: 2167, SEQ ID NO: 2105, SEQ ID NO: 2108, SEQ ID NO: 2112, SEQ ID NO: 2160, SEQ ID NO: 2170, SEQ ID NO: 2114, SEQ ID NO: 2171, SEQ ID NO: 2112, SEQ ID NO: 2173, SEQ ID NO: 2102, SEQ ID NO: 2174, SEQ ID NO: 2175, SEQ ID NO: 2109, SEQ ID NO: 2176, SEQ ID NO: 2238, or SEQ ID NO: 2239.

In some embodiments, the gene editing pair comprises a CasX selected from any one of CasX of sequence SEQ ID NO: 270, SEQ ID NO: 292, SEQ ID NO: 311, SEQ ID NO: 333, or SEQ ID NO: 336, and a gNA selected from any one of SEQ ID NOS: 2104, 2106, or 2238.

In some embodiments, the gene editing pair comprises a CasX variant selected from any one of SEQ ID NOS: 247-337, 3301-3493, 3498-3501, 3505-3520, 3540-3549 and 4412-4415. In some embodiments, the gene editing pair comprises a CasX variant selected from any one of 247-337, 3498-3501, 3505-3520, 3540-3549 and 4412-4415. In some embodiments, the gene editing pair comprises a CasX variant selected from any one of 3498-3501, 3505-3520, and 3540-3549.

In some embodiments, the gene editing pair comprises a CasX variant selected from any one of SEQ ID NOS: 247-337, 3301-3493, 3498-3501, 3505-3520, 3540-3549 and 4412-4415 and a gNA selected from the group consisting of any one of SEQ ID NOS: 412-3295. In some embodiments, the gene editing pair comprises a CasX variant selected from any one of 247-337, 3498-3501, 3505-3520, 3540-3549 and 4412-4415, and a gNA selected from the group consisting of any one of SEQ ID NOS: 412-3295. In some embodiments, the gene editing pair comprises a CasX variant selected from any one of 3498-3501, 3505-3520, and 3540-3549, and a gNA selected from the group consisting of any one of SEQ ID NOS: 412-3295.

In some embodiments, the gene editing pair comprises a CasX variant selected from any one of SEQ ID NOS: 247-337, 3301-3493, 3498-3501, 3505-3520, 3540-3549 and 4412-4415 and a gNA selected from the group consisting of any one of SEQ ID NOS: 2101-2280. In some embodiments, the gene editing pair comprises a CasX variant selected from any one of 247-337, 3498-3501, 3505-3520, 3540-3549 and 4412-4415, and a gNA selected from the group consisting of any one of SEQ ID NOS: 2101-2280. In some embodiments, the gene editing pair comprises a CasX variant selected from any one of 3498-3501, 3505-3520, and 3540-3549, and a gNA selected from the group consisting of any one of SEQ ID NOS: 2101-2280.

In some embodiments, the gene editing pair comprises a CasX variant selected from any one of SEQ ID NOS: 247-337, 3301-3493, 3498-3501, 3505-3520, 3540-3549 and 4412-4415 and a gNA selected from the group consisting of any one of SEQ ID NOS: 2236, 2237, 2238, 2241, 2244, 2248, 2249, and 2259-2280. In some embodiments, the gene editing pair comprises a CasX variant selected from any one of 247-337, 3498-3501, 3505-3520, 3540-3549 and 4412-4415, and a gNA selected from the group consisting of any one of SEQ ID NOS: 2236, 2237, 2238, 2241, 2244, 2248, 2249, and 2259-2280. In some embodiments, the gene editing pair comprises a CasX variant selected from any one of 3498-3501, 3505-3520, and 3540-3549, and a gNA selected from the group consisting of any one of SEQ ID NOS: 2236, 2237, 2238, 2241, 2244, 2248, 2249, and 2259-2280.

In still further embodiments, the present disclosure provides a gene editing pair comprising a CasX protein and a gNA, wherein the gNA is a guide RNA variant as described herein. In some embodiments of the gene editing pairs of the disclosure, the Cas protein is a CasX variant as described herein. In some embodiments, the CasX protein is a reference CasX protein of SEQ ID NO: 1, SEQ ID NO: 2, or SEQ ID NO: 3 and the gNA is a guide RNA variant as described herein. Exemplary improved characteristics of the gene editing pair embodiments, as described herein, may in some embodiments include improved protein:gNA complex stability, improved ribonuclear protein complex (RNP) formation, higher percentage of cleavage-competent RNP, improved binding affinity between the CasX protein and gNA, improved binding affinity to the target DNA, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, or improved resistance to nuclease activity. In the foregoing embodiments, the improvement is at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the characteristic of a reference CasX protein and reference gNA pair.

In some embodiments, wherein the gene editing pair comprises both a CasX variant protein and a gNA variant as described herein, the one or more characteristics of the gene editing pair is improved beyond what can be achieved by varying the CasX protein or the gNA alone. In some embodiments, the CasX variant protein and the gNA variant act additively to improve one or more characteristics of the gene editing pair. In some embodiments, the CasX variant protein and the gNA variant act synergistically to improve one or more characteristics of the gene editing pair. In the foregoing embodiments, the improvement is at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the characteristic of a reference CasX protein and reference gNA pair.

VI. Methods of Making CasX Variant Protein and gNA Variants

The CasX variant proteins and gNA variants as described herein may be constructed through a variety of methods. Such methods may include, for example, Deep Mutational Evolution (DME), described below and in the Examples.

a. Deep Mutational Evolution (DME)

In some embodiments, DME is used to identify CasX protein and sgNA scaffold variants with improved function. The DME method, in some embodiments, comprises building and testing a comprehensive set of mutations to a starting biomolecule to produce a library of biomolecule variants; for example, a library of CasX variant proteins or sgNA scaffold variants. DME can encompass making all possible substitutions, as well as all possible small insertions, and all possible deletions of amino acids (in the case of proteins) or nucleotides (in the case of RNA or DNA) to the starting biomolecule. A schematic illustrating DME methods is shown in FIG. 1. In some embodiments, DME comprises a subset of all such possible substitutions, insertions, and deletions. In certain embodiments of DME, one or more libraries of variants are constructed, evaluated for functional changes, and this information used to construct one or more additional libraries. Such iterative construction and evaluation of variants may lead, for example, to identification of mutational themes that lead to certain functional outcomes, such as regions of the protein or RNA that when mutated in a certain way lead to one or more improved functions. Layering of such identified mutations may then further improve function, for example through additive or synergistic interactions. DME comprises library design, library construction, and library screening. In some embodiments, multiple rounds of design, construction, and screening are undertaken.

b. Library Design

DME methods produce variants of biomolecules, which are polymers of many monomers. In some embodiments, the biomolecule comprises a protein or a ribonucleic acid (RNA) molecule, wherein the monomer units are amino acids or ribonucleotides, respectively. The fundamental units of biomolecule mutation comprise either: (1) exchanging one monomer for another monomer of different identity (substitutions); (2) inserting one or more additional monomer in the biomolecule (insertions); or (3) removing one or more monomer from the biomolecule (deletions). DME libraries comprising substitutions, insertions, and deletions, alone or in combination, to any one or more monomers within any biomolecule described herein, are considered within the scope of the invention.

In some embodiments, DME is used to build and test the comprehensive set of mutations to a biomolecule, encompassing all possible substitutions, as well as small insertions and deletions of amino acids (in the case of proteins) or nucleotides (in the case of RNA). The construction and functional readout of these mutations can be achieved with a variety of established molecular biology methods. In some embodiments, the library comprises a subset of all possible modifications to monomers. For example, in some embodiments, a library collectively represents a single modification of one monomer, for at least 10% of the total monomer locations in a biomolecule, wherein each single modification is selected from the group consisting of substitution, single insertion, and single deletion. In some embodiments, the library collectively represents the single modification of one monomer, for at least 5%, at least 10%, at least 20%, at least 30%, at least 40%, at least 50%, at least 60%, at least 70%, at least 80%, at least 90%, at least 95%, or up to 100% of the total monomer locations in a starting biomolecule. In certain embodiments, for a certain percentage of the total monomer locations in a starting biomolecule, the library collectively represents each possible single modification of a one monomer, such as all possible substitutions with the 19 other naturally occurring amino acids (for a protein) or 3 other naturally occurring ribonucleotides (for RNA), insertion of each of the 20 naturally occurring amino acids (for a protein) or 4 naturally occurring ribonucleotides (for RNA), or deletion of the monomer. In still further embodiments, insertion at each location is independently greater than one monomer, for example insertion of two or more, three or more, or four or more monomers, or insertion of between one to four, between two to four, or between one to three monomers. In some embodiments, deletion at location is independently greater than one monomer, for example deletion of two or more, three or more, or four or more monomers, or deletion of between one to four, between two to four, or between one to three monomers. Examples of such libraries of CasX variants and gNA variants are described in Examples 24 and 25, respectively.

In some embodiments, the biomolecule is a protein and the individual monomers are amino acids. In those embodiments where the biomolecule is a protein, the number of possible DME mutations at each monomer (amino acid) position in the protein comprise 19 amino acid substitutions, 20 amino acid insertions and 1 amino acid deletion, leading to a total of 40 possible mutations per amino acid in the protein.

In some embodiments, a DME library of CasX variant proteins comprising insertions is 1 amino acid insertion library, a 2 amino acid insertion library, a 3 amino acid insertion library, a 4 amino acid insertion library, a 5 amino acid insertion library, a 6 amino acid insertion library, a 7 amino acid insertion library, an 8 amino acid insertion library, a 9 amino acid insertion library or a 10 amino acid insertion library. In some embodiments, a DME library of CasX variant proteins comprising insertions comprises between 1 and 4 amino acid insertions.

In some embodiments, the biomolecule is RNA. In those embodiments where the biomolecule is RNA, the number of possible DME mutations at each monomer (ribonucleotide) position in the RNA comprises 3 nucleotide substitutions, 4 nucleotide insertions, and 1 nucleotide deletion, leading to a total of 8 possible mutations per nucleotide.

In some embodiments, DME library design comprises enumerating all possible mutations for each of one or more target monomers in a biomolecule. As used herein, a "target monomer" refers to a monomer in a biomolecule polymer that is targeted for DME with the substitutions, insertions and deletions described herein. For example, a target monomer can be an amino acid at a specified position in a protein, or a nucleotide at a specified position in an RNA. A biomolecule can have at least 1, 2, 3, 4, 5, 6, 7, 8, 9, 10, 20, 30, 40, 50, 100 or more target monomers that are systematically mutated to produce a DME library of biomolecule variants. In some embodiments, every monomer in a biomolecule is a target monomer. For example, in DME of a protein where there are two target amino acids, DME library design comprises enumerating the 40 possible DME mutations at each of the two target amino acids. In a further example, in DME of an RNA where there are four target nucleotides, DME library design comprises enumerating the 8 possible DME mutations at each of the four target nucleotides. In some embodiments, each target monomer of a biomolecule is independently randomly selected or selected by intentional design. Thus, in some embodiments, a DME library comprises random variants, or variants that were designed, or variants comprising random mutations and designed mutations within a single biomolecule, or any combinations thereof.

In some embodiments of DME methods, DME mutations are incorporated into double-stranded DNA encoding the biomolecule. This DNA can be maintained and replicated in a standard cloning vector, for example a bacterial plasmid, referred to herein as the target plasmid. An exemplary target plasmid contains a DNA sequence encoding the starting biomolecule that will be subjected to DME, a bacterial origin of replication, and a suitable antibiotic resistance expression cassette. In some embodiments, the antibiotic resistance cassette confers resistance to kanamycin, ampicillin, spectinomycin, bleomycin, streptomycin, erythromycin, tetracycline or chloramphenicol. In some embodiments, the antibiotic resistance cassette confers resistance to kanamycin.

A library comprising said variants can be constructed in a variety of ways. In certain embodiments, plasmid recombineering is used to construct a library. Such methods can use DNA oligonucleotides encoding one or more mutations to incorporate said mutations into a plasmid encoding the reference biomolecule. For biomolecule variants with a plurality of mutations, in some embodiments more than one oligonucleotide is used. In some embodiments, the DNA oligonucleotides encoding one or more mutations wherein the mutation region is flanked by between 10 and 100 nucleotides of homology to the target plasmid, both 5' and 3' to the mutation. Such oligonucleotides can in some embodiments be commercially synthesized and used in PCR amplification. An exemplary template for an oligonucleotide encoding a mutation is provided below:

$$5'(N)_{10-100}\text{-Mutation-}(N')_{10-100}3'$$

In this exemplary oligonucleotide design, the Ns represent a sequence identical to the target plasmid, referred to herein as the homology arms. When a particular monomer in the biomolecule is targeted for mutation, these homology arms directly flank the DNA encoding the monomer in the target plasmid. In some exemplary embodiments where the biomolecule undergoing DME is a protein, 40 different oligonucleotides, using the same set of homology arms, are used to encode the enumerated 40 different amino acid mutations for each amino acid residue in the protein that is targeted for DME. When the mutation is of a single amino acid, the region encoding the desired mutation or mutations comprises three nucleotides encoding an amino acid (for substitutions or single insertions), or zero nucleotides (for deletions). In some embodiments, the oligonucleotide encodes insertion of greater than one amino acid. For example, wherein the oligonucleotide encodes the insertion of X amino acids, the region encoding the desired mutation comprises 3*X nucleotides encoding the X amino acids. In some embodiments, the mutation region encodes more than one mutation, for example mutations to two or more monomers of a biomolecule that are in close proximity (e.g., next to each other, or within 1, 2, 3, 4, 5, 6, 7, 8, 9, or 10, or more monomers of each other).

Nucleotide sequences code for particular amino acid monomers in a substitution or insertion mutation in an oligo as described herein will be known to the person of ordinary skill in the art. For example, TTT or TTC triplets can be used to encode phenylalanine; TTA, TTG, CTT, CTC, CTA or CTG can be used to encode leucine; ATT, ATC or ATA can be used to encode isoleucine; ATG can be used to encode methionine; GTT, GTC, GTA or GTG c can be used to encode valine; TCT, TCC, TCA, TCG, AGT or AGC can be used to encode serine; CCT, CCC, CCA or CCG can be used to encode proline; ACT, ACC, ACA or ACG can be used to encode threonine; GCT, GCC, GCA or GCG can be used to encode alanine; TAT or TAC can be used to encode tyrosine; CAT or CAC can be used to encode histidine; CAA or CAG can be used to encode glutamine, AAT or AAC can be used to encode asparagine; AAA or AAG can be used to encode lysine; GAT or GAC can be used to encode aspartic acid; GAA or GAG can be used to encode glutamic acid; TGT or TGC c can be used to encode cysteine; TGG can be used to encode tryptophan; CGT, CGC, CGA, CGG, AGA or AGG can be used to encode arginine; and GGT, GGC, GGA or GGG can be used to encode glycine. In addition, ATG is used for initiation of the peptide synthesis as well as for methionine and TAA, TAG and TGA can be used to encode for the termination of the peptide synthesis.

In some exemplary embodiments where the biomolecule undergoing DME is an RNA, 8 different oligonucleotides, using the same set of homology arms, encode the above enumerated 8 different single nucleotide mutations for each nucleotide in the RNA that is targeted for DME. When the mutation is of a single ribonucleotide, the region of the oligo encoding the mutations can consist of the following nucleotide sequences: one nucleotide specifying a nucleotide (for substitutions or insertions), or zero nucleotides (for deletions). In some embodiments, the oligonucleotides are synthesized as single stranded DNA oligonucleotides. In some embodiments, all oligonucleotides targeting a particular amino acid or nucleotide of a biomolecule subjected to DME are pooled. In some embodiments, all oligonucleotides targeting a biomolecule subjected to DME are pooled. There is no limit to the type or number of mutations that can be created simultaneously in a DME library.

c. DME Library Construction

In some embodiments, plasmid recombineering is utilized to construct one or more DME libraries. Plasmid recombineering is described in Higgins, Sean A., Sorel V. Y. Ouonkap, and David F. Savage (2017) "Rapid and Programmable Protein Mutagenesis Using Plasmid Recombineering" ACS Synthetic Biology, the contents of which are incorporated herein by reference in their entirety.

An exemplary library construction protocol shown below:

Day 1: A bla, bio-, lambda-Red1, mutS-, cmR *E. coli* strain (for example, EcNR2, Addgene ID: 26931) is streaked out on a LB agar plate containing standard concentrations of the antibiotics Chloramphenicol and Ampicillin. Colonies are grown overnight at 30° C.

Day 2: A single colony of EcNR2 is picked into 5 mL of LB liquid media containing standard concentrations of the antibiotics Chloramphenicol and Ampicillin. The culture is grown overnight with shaking at 30° C.

Day 3: Electrocompetent cells are made using any method known in the art. An non-limiting, exemplary protocol for making electrocompetent cells comprises:

(1) Dilute 50 uL of the overnight culture into 50 mL of LB liquid media containing standard concentrations of the antibiotics Chloramphenicol and Ampicillin. Grow this 50 mL culture with shaking at 30° C.

(2) Once the 50 mL culture has grown to an OD600=0.5, transfer to shaking growth at 42° C. in a liquid water bath. Care should be taken to limit this growth at 42° C. to 15 minutes.

(3) After heated growth, transfer the culture to an ice water bath and swirl for at least one minute to cool the culture.

(4) Pellet the culture by spinning at 4,000×g for 10 minutes. Decant the supernatant.

(5) Carefully wash and re-suspend the pellet by adding ice cold water up to 50 mL. Repeat spin step 4.

(6) Resuspend the pellet in 1 mL of ice cold water. The cells are now competent for a standard electroporation step.

The electrocompetent *E. coli* are then transformed with the DME oligonucleotides:

(1) Pooled DME oligonucleotides are diluted in water to a final concentration of 20 µM. If more than one mutation is to be generated simultaneously, the corresponding oligonucleotides should be combined and mixed thoroughly.

(2) Pure target plasmid, for example, from a miniprep, is diluted in water to a final concentration of 10 ng per µL.

(3) Mix on ice:
2.5 µL DME oligonucleotide mixture
1 µL target plasmid
46.5 µL electrocompetent EcNR2 cells (4) Transfer the mixture to a sterile 0.1 cm electroporation cuvette on ice and perform an electroporation. For example, the parameters of 1800 kV, 200 Ω, 25 µF can be used.

(5) Recover the electroporated cells by adding 1 mL of standard warm SOC media. Grow the culture for one hour with shaking at 30° C.

(6) After the recovery, add 4 mL of additional standard LB media to the culture. Add Kanamycin antibiotic at standard concentrations in order to select for the electroporated target plasmid. The culture is then grown=overnight with shaking at 30° C.

Day 4. Methods of isolating the target plasmid from overnight cultures will be readily apparent to one of ordinary skill in the art. For example, target plasmid can be isolated using commercial MiniPrep kits such as the MiniPrep kit from Qiagen. The plasmid library obtained comprises mutated target plasmids. In some embodiments, the plasmid library comprises between 10% and 30% mutated target plasmids. Additional mutations can be progressively added by repeatedly passing the library through rounds of electroporation and outgrowth, with no practical limit on the number of rounds that may be performed. Thus, for example, in some embodiments the library comprises plasmids encoding greater than one mutation per plasmid. For example, in some embodiments the library comprises plasmids independently comprising one, two, three, four, five, six, seven eight, nine, or greater mutations per plasmid. In some embodiments, plasmids that do not comprise any mutations are also present (e.g., plasmids which did not incorporate a DME oligonucleotide).

In other embodiments, methods other than plasmid recombineering are used to construct one or more DME libraries, or a combination of plasmid recombineering and other methods are used to construct one or more DME libraries. For example, DME libraries may, in some embodiments, be constructed using one of the other mutational methods described herein. Such libraries may then be taken through the library screening as described herein, and further iterations be carried out if desired.

d. Library Screening

Any appropriate method for screening or selecting a DME library is envisaged as following within the scope of the inventions. High throughput methods may be used to evaluate large libraries with thousands of individual mutations. In some embodiments, the throughput of the library screening or selection assay has a throughput that is in the millions of individual cells. In some embodiments, assays utilizing living cells are preferred, because phenotype and genotype are physically linked in living cells by nature of being contained within the same lipid bilayer. Living cells can also be used to directly amplify sub-populations of the overall library. In other embodiments, smaller assays are used in DME methods, for example to screen a focused library developed through multiple rounds of mutation and evaluation. Exemplary methods of screening libraries are described in Examples 24 and 25.

An exemplary, but non-limiting DME screening assay comprises Fluorescence-Activated Cell Sorting (FACS). In some embodiments, FACS may be used to assay millions of unique cells in a DME library. An exemplary FACS screening protocol comprises the following steps:

(1) PCR amplifying the purified plasmid library from the library construction phase. Flanking PCR primers can be designed that add appropriate restriction enzyme sites flanking the DNA encoding the biomolecule. Standard oligonucleotides can be used as PCR primers, and can be synthesized commercially. Commercially available PCR reagents can be used for the PCR amplification, and protocols should be performed according to the manufacturer's instructions. Methods of designing PCR primers, choice of appropriate restriction enzyme sites, selection of PCR reagents and PCR amplification protocols will be readily apparent to the person of ordinary skill in the art.

(2) The resulting PCR product is digested with the designed flanking restriction enzymes. Restriction enzymes may be commercially available, and methods of restriction enzyme digestion will be readily apparent to the person of ordinary skill in the art.

(3) The PCR product is ligated into a new DNA vector. Appropriate DNA vectors may include vectors that allow for the expression of the DME library in a cell. Exemplary vectors include, but are not limited to, retroviral vectors, lentiviral vectors, adenoviral vectors, adeno-associated viral (AAV) vectors and plasmids. This new DNA vector can be part of a protocol such as lentiviral integration in mammalian tissue culture, or a simple expression method such as plasmid transformation in bacteria. Any vectors that allow for the expression of the biomolecule, and the DME library of variants thereof, in any suitable cell type, are considered within the scope of the disclosure. Cell types may include bacterial cells, yeast cells, and mammalian cells. Exemplary bacterial cell types may include *E. coli*. Exemplary yeast cell types may include *Saccharomyces cerevisiae*. Exemplary mammalian cell types may include mouse, hamster, and human cell lines, such as HEK293 cells, HEK293T cells, HEK293-F cells, Lenti-X 293T cells, BHK cells, HepG2 cells, Saos-2 cells, HuH7 cells, A549 cells, NS0 cells, SP2/0 cells, YO myeloma cells, P3X63 mouse myeloma cells, PER cells, PER.C6 cells, hybridoma cells, VERO cells, NIH3T3 cells, COS, WI38 cells, MRC5 cells, HeLa, HT1080 cells, or CHO cells. Choice of vector and cell type will be readily apparent to the person of ordinary skill in the art. DNA ligase enzymes can be purchased commercially, and protocols for their use will also be readily apparent to one of ordinary skill in the art.

Figure 2:
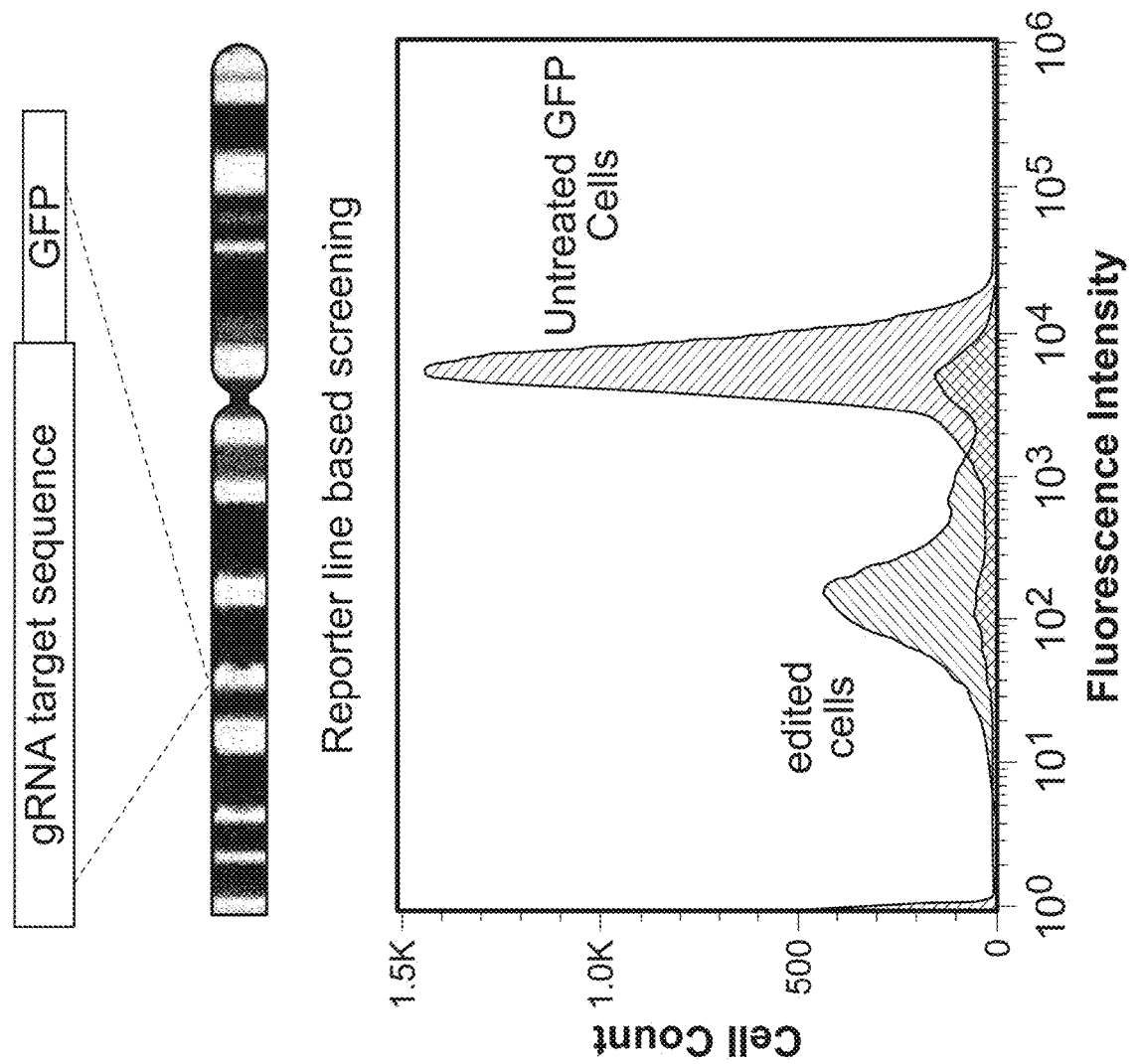
FIG. 2 is a diagram and an example fluorescence activated cell sorting (FACS) plot illustrating an exemplary method for assaying the effectiveness of a reference CasX protein or single guide RNA (sgRNA), or variants thereof. A reporter (e.g. GFP reporter) coupled to a gRNA target sequence, complementary to the gRNA spacer, is integrated into a reporter cell line. Cells are transformed or transfected with a CasX protein and/or sgNA variant, with the spacer motif of the sgRNA complementary to and targeting the gRNA target sequence of the reporter. Ability of the CasX:sgRNA ribonucleoprotein complex to cleave the target sequence is assayed by FACS. Cells that lose reporter expression indicate occurrence of CasX:sgRNA ribonucleoprotein complex-mediated cleavage and indel formation.
Figure 3A:
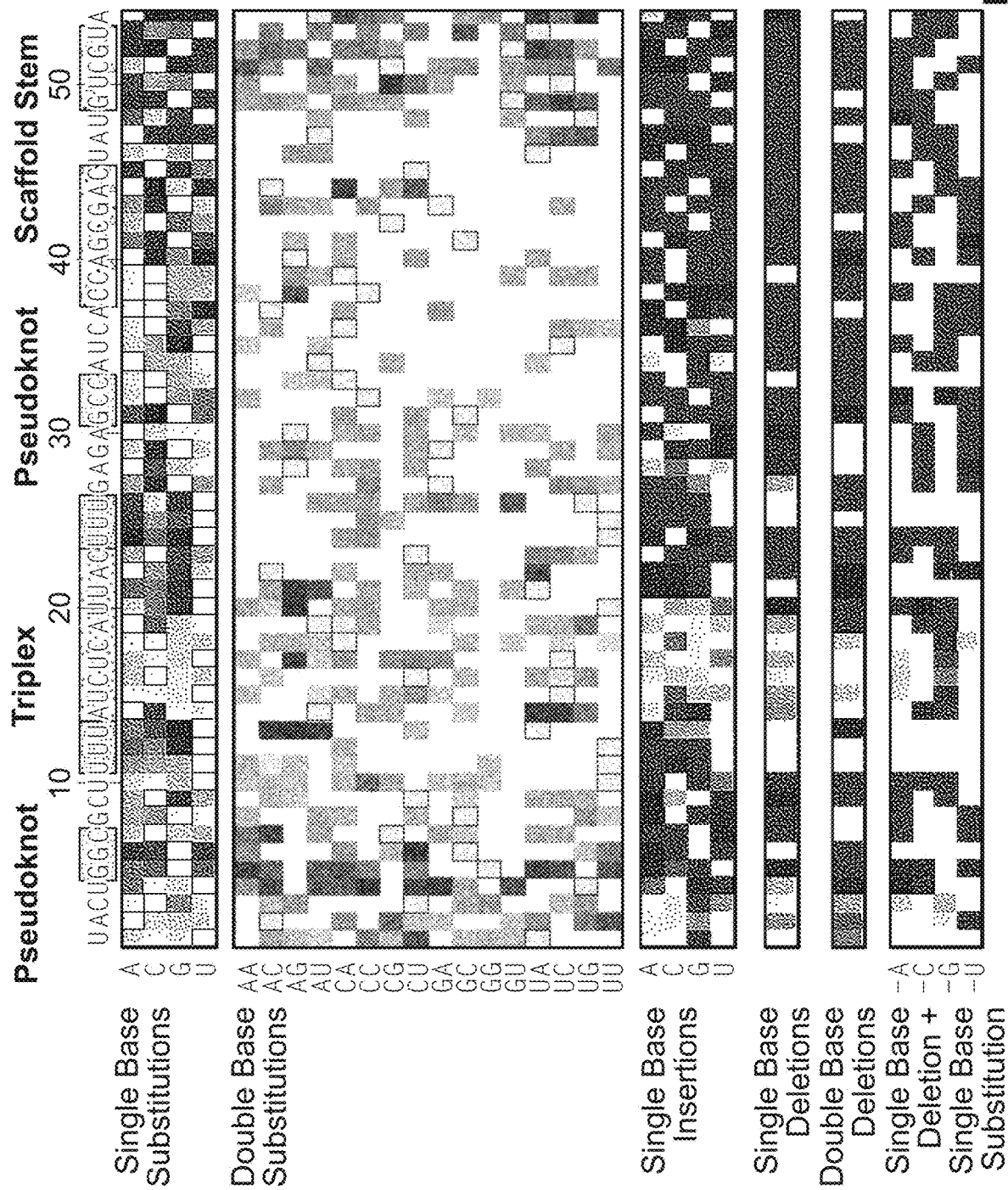
FIG. 3A and FIG. 3B are heat maps showing the results of an exemplary DME mutagenesis of the reference sgRNA encoded by SEQ ID NO: 5, as described in Example 3.
Figure 3A:
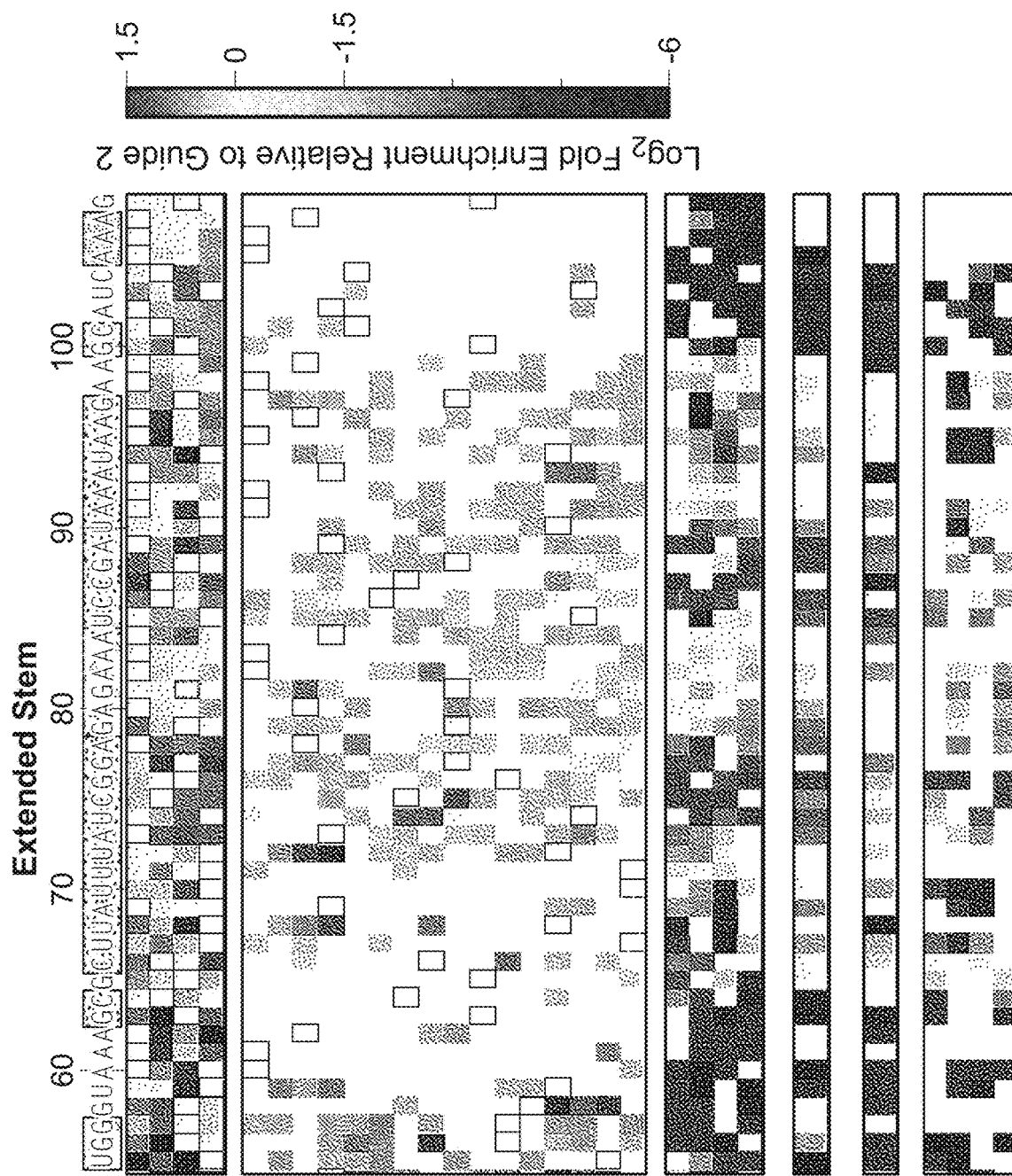
Figure 3B:
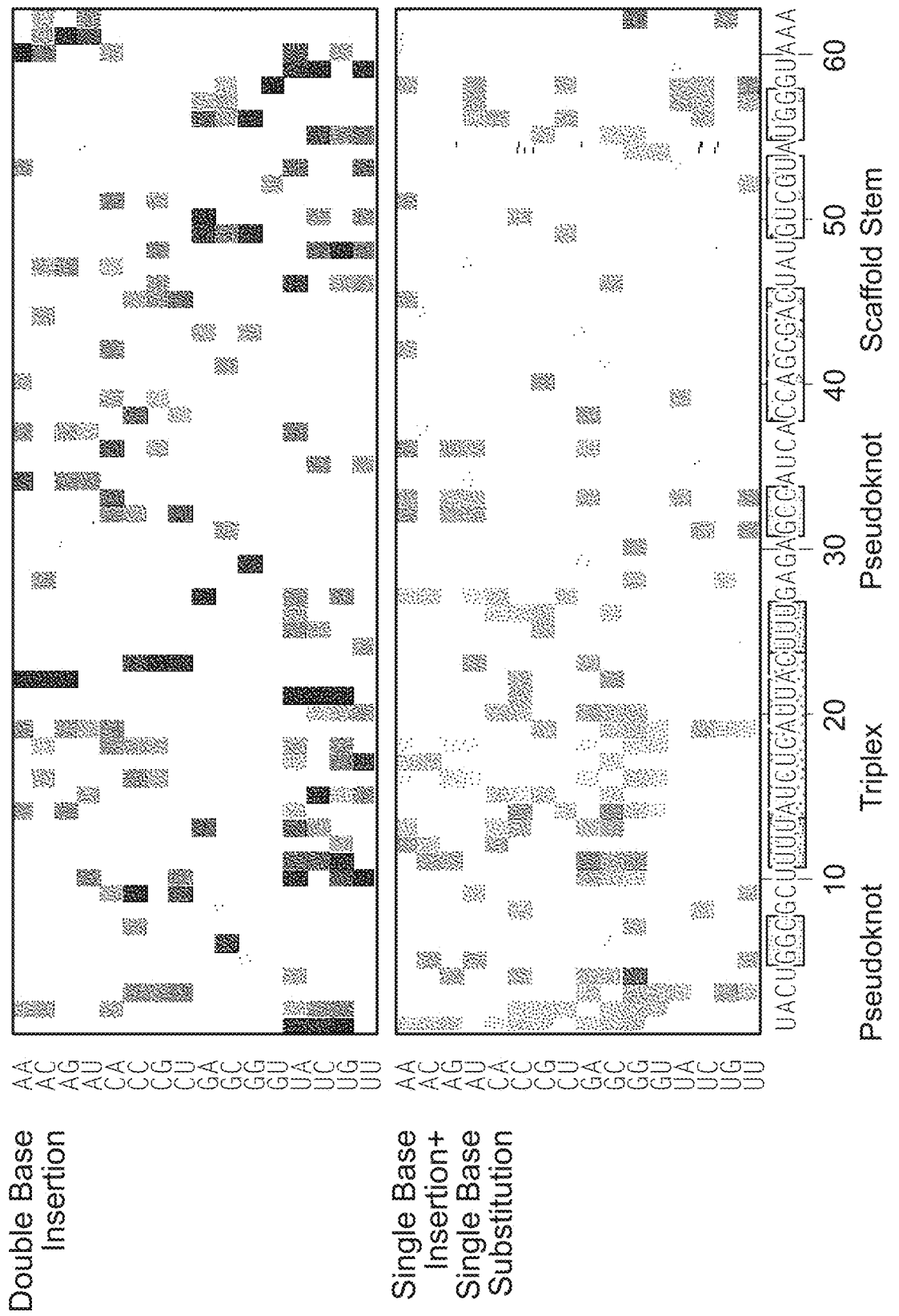
Figure 3B:
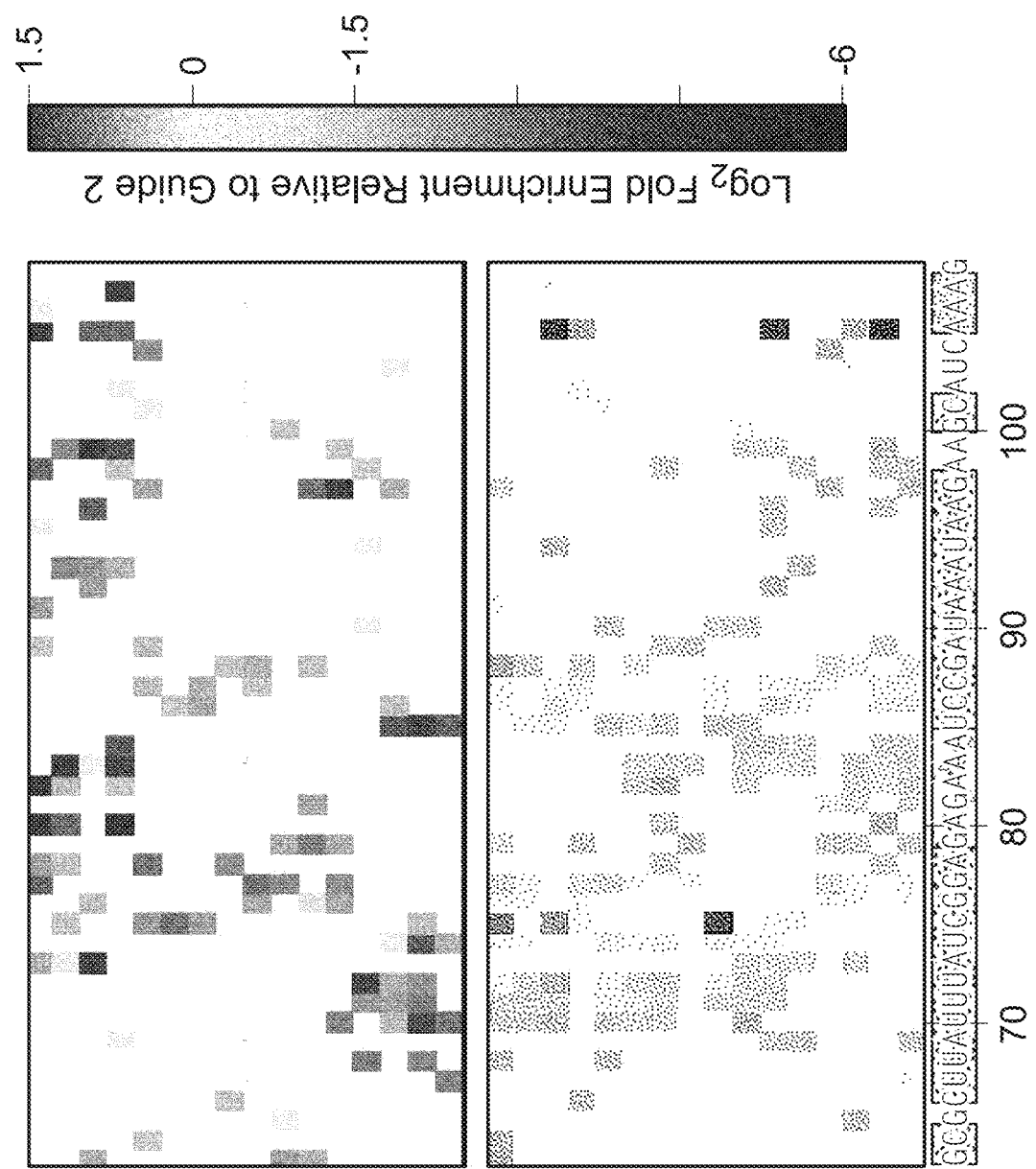
Figure 4A:
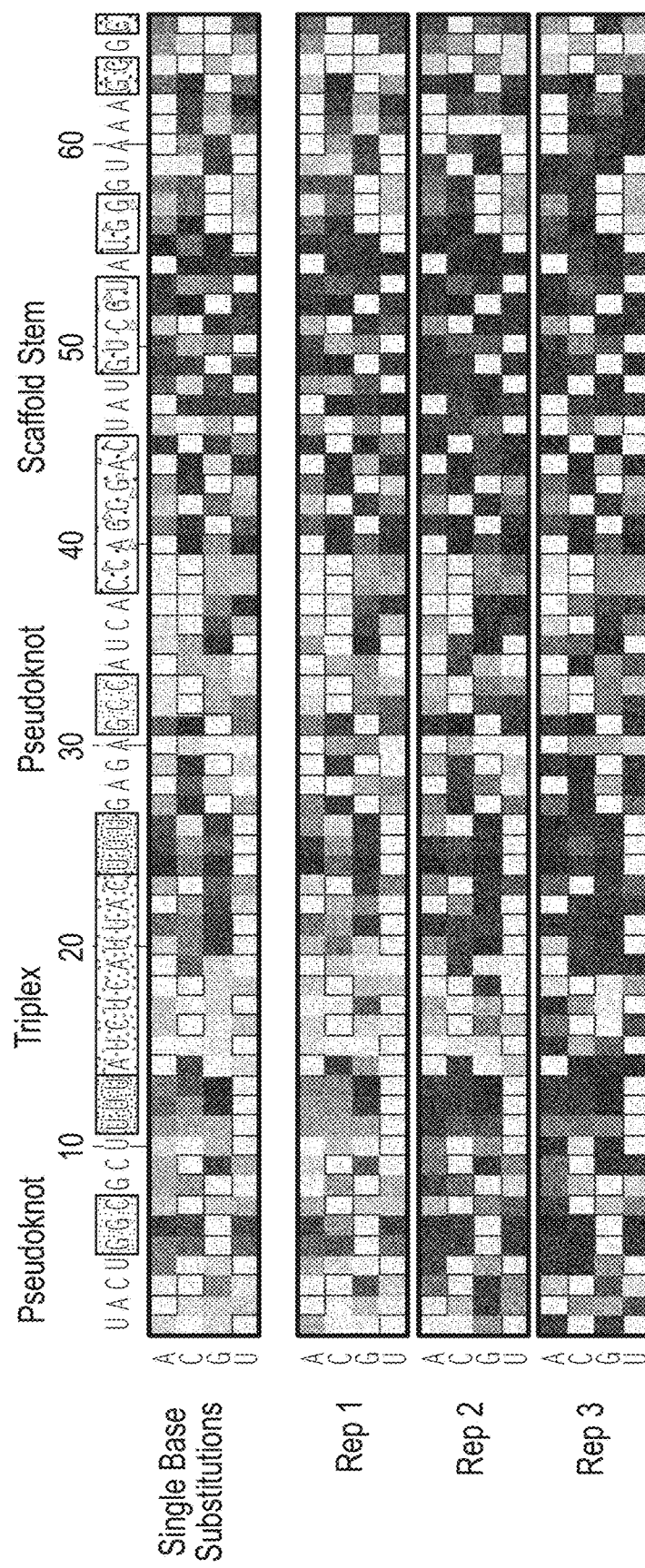
FIG. 4A shows the results of exemplary DME experiments using a reference sgRNA, as described in Example 3. The improved reference sgNA (an sgRNA) with a sequence of SEQ ID NO: 5 is shown at top, and $Log_2$ fold enrichment of the variant in the DME library relative to the reference sgRNA following selection is indicated in grayscale. Enrichment is a proxy for activity, where greater enrichment is a more active molecule. The heat map shows an exemplary DME experiment showing four replicates of a library where every base pair in the reference sgRNA has been substituted with every possible alternative base pair.
Figure 4A:
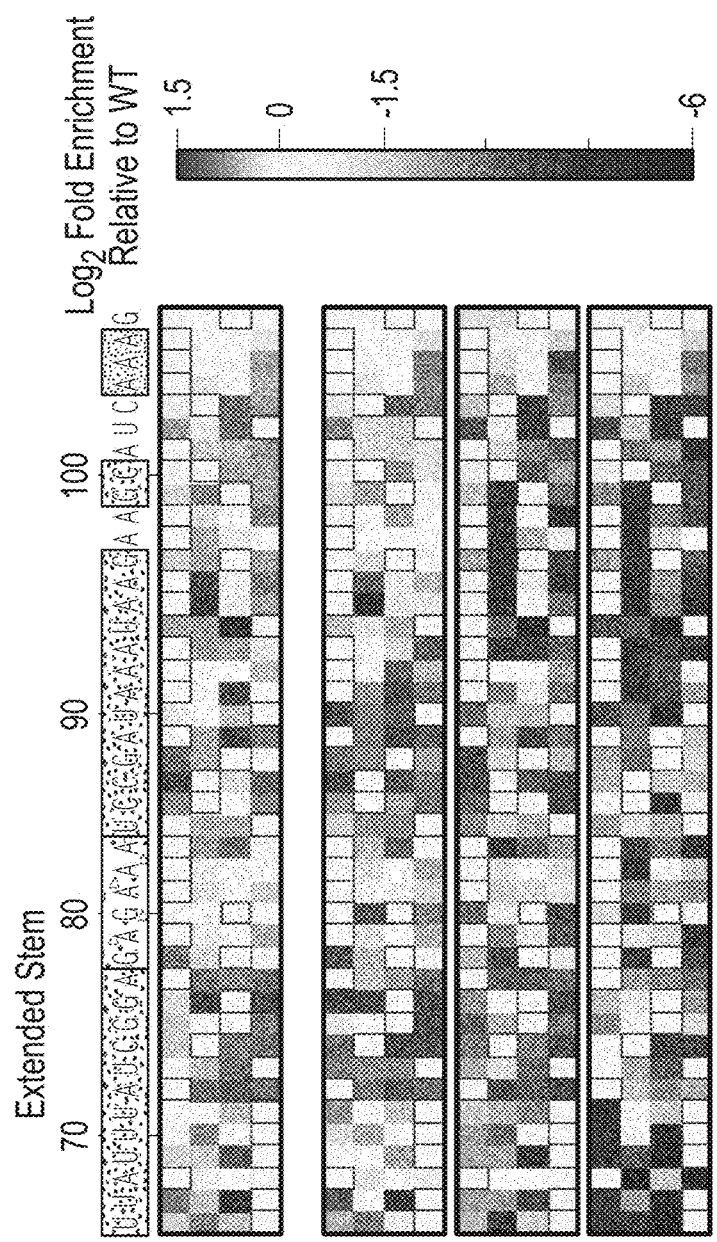
Figure 4B:
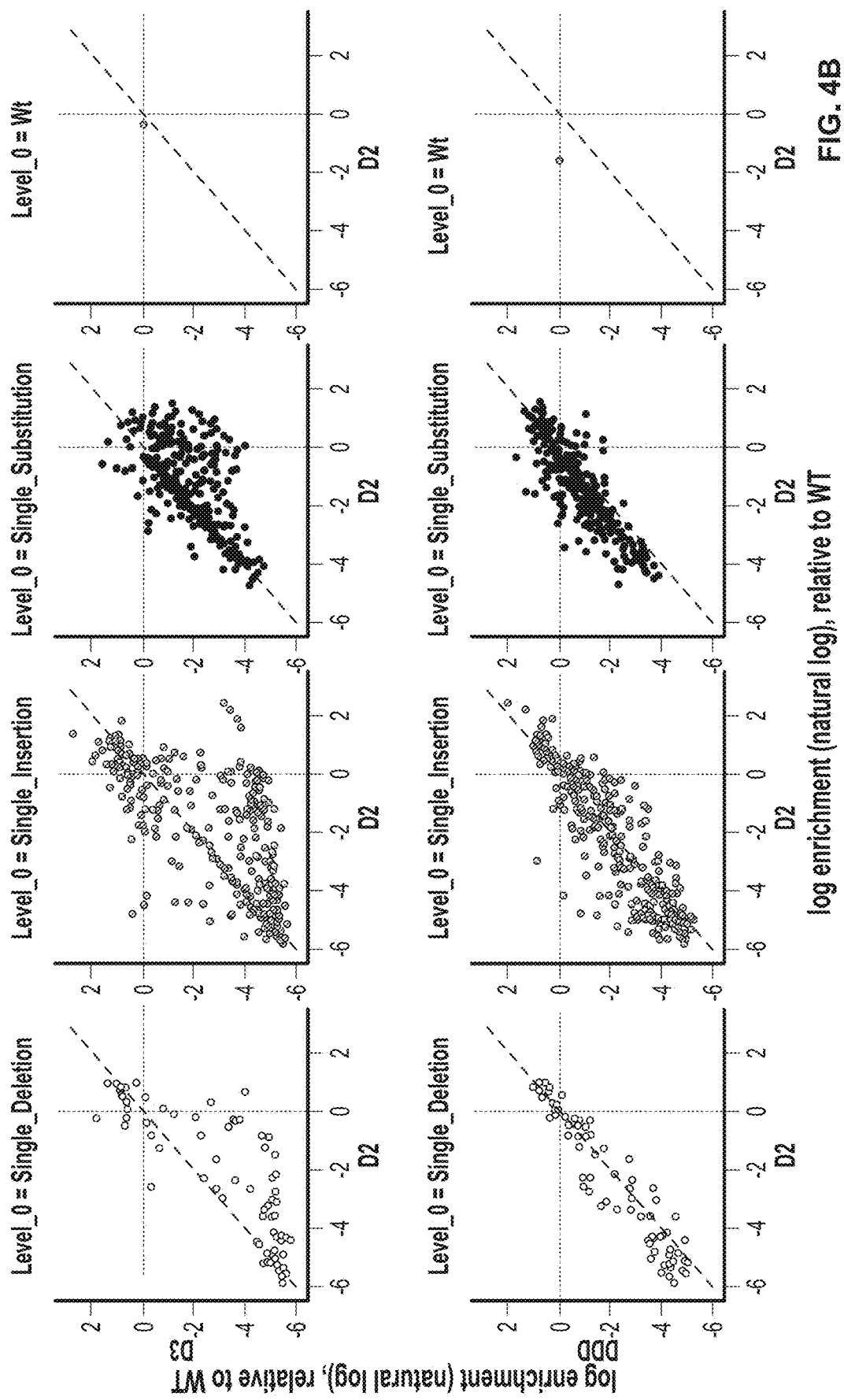
FIG. 4B is a series of 8 plots that compare biological replicates of different DME libraries. The $Log_2$ fold enrichment of individual variants relative to the reference sgRNA sequence for pairs of DME replicates are plotted against each other. Shown are plots for single deletion, single insertion and single substitution DME experiments, as well as wild type controls, and the plots indicate that there is a good amount of agreement for each replicate.
Figure 4C:
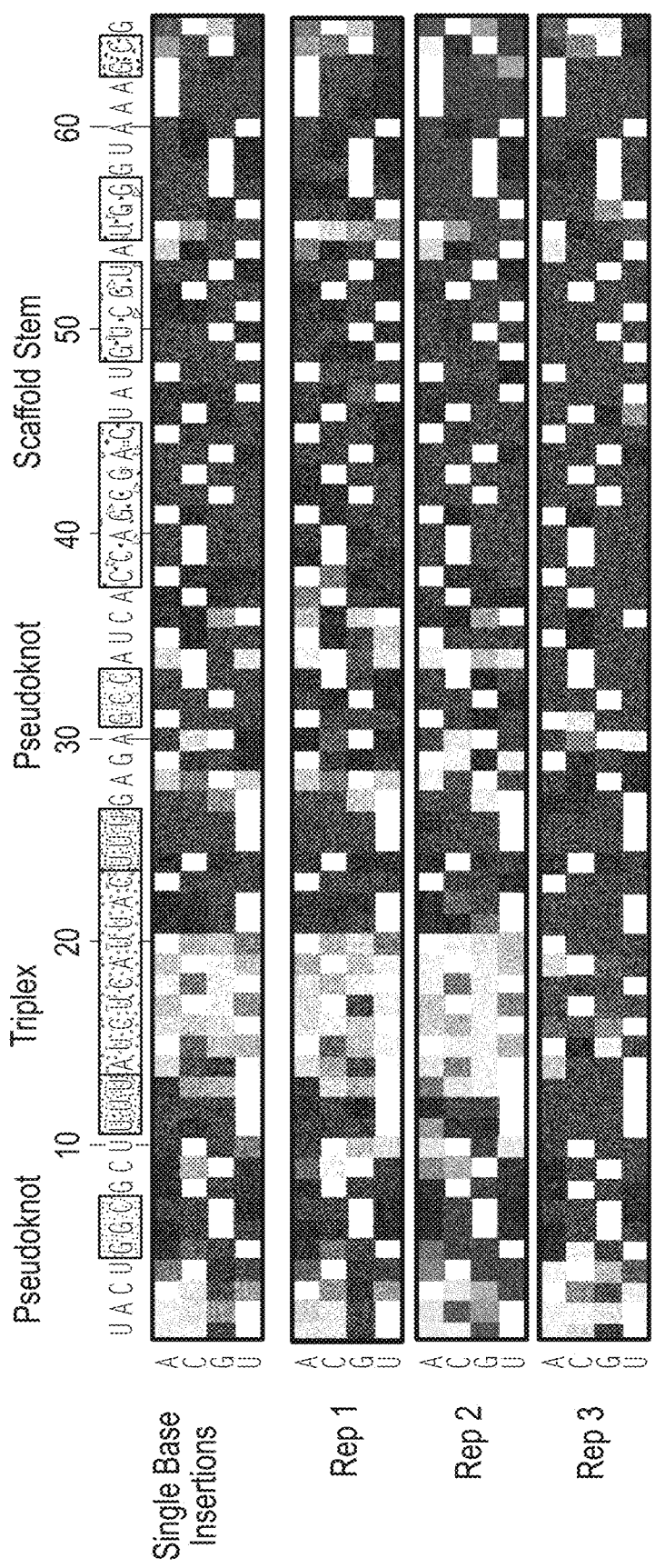
FIG. 4C is a heat map of an exemplary DME experiment showing four replicates of a library where every location in the reference sgRNA has undergone a single base pair insertion. The DME experiment used a reference sgRNA of SEQ ID NO: 5 (at top), and was performed as described in Example 3. $Log_2$ fold enrichment of the variant in the DME library relative to the reference sgRNA following selection is indicated in grayscale.
Figure 4C:
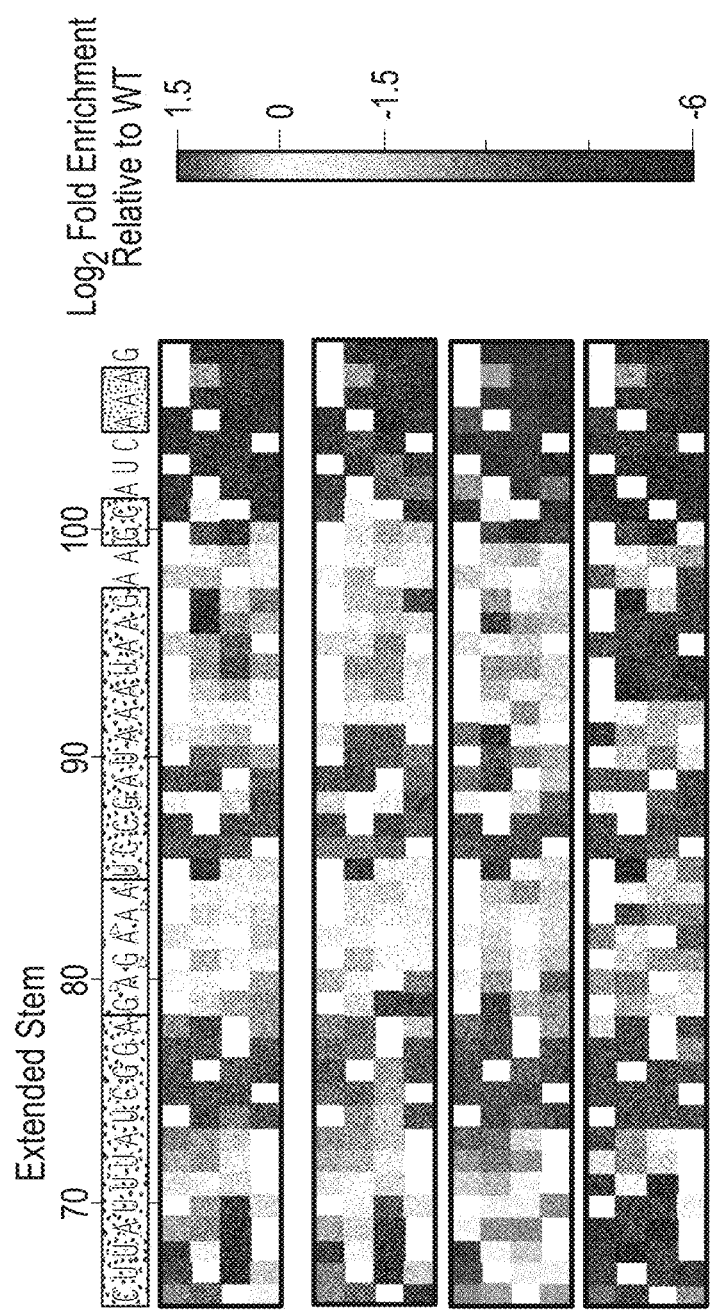

(4) Once the DME library has been cloned into a vector suitable for in vivo expression, the DME library is screened. If the biomolecule has a function which alters fluorescent protein production in a living cell, the biomolecule's biochemical function will be correlated with the fluorescence intensity of the cell overall. By observing a population of millions of cells on a flow cytometer, a DME library can be seen to produce a broad distribution of fluorescence intensities. Individual sub-populations from this overall broad distribution can be extracted by FACS. For example, if the function of the biomolecule is to repress expression of a fluorescent protein, the least bright cells will be those expressing biomolecules whose function has been improved by DME. Alternatively, if the function of the biomolecule is to increase expression of a fluorescent protein, the brightest cells will be those expressing biomolecules whose function has been improved by DME. Cells can be isolated based on fluorescence intensity by FACS and grown separately from the overall population. An exemplary FACS screening assay is shown in FIG. 2.

(5) After FACS sorting cells expressing a DME library of biomolecule variants, cultures comprising the original DME library and/or only highly functional biomolecule variants, as determined by FACS sorting, can be amplified separately. If the cells that were FACS sorted comprise cells that express the DME library of biomolecule variants from a plasmid (for example, *E. coli* cells transformed with a plasmid expression vector), these plasmids can be isolated, for example through miniprep. Conversely if the DME library of biomolecule variants has been integrated into the genomes of the FACs sorted cells, this DNA region can be PCR amplified and, optionally, subcloned into a suitable vector for further characterization using methods known in the art. Thus, the end product of library screening is a DNA library representing the initial, or 'naive', DME library, as well as one or more DNA libraries containing sub-populations of the naive DME library, which comprise highly functional mutant variants of the biomolecule identified by the screening processes described herein.

In some embodiments, DME libraries that have been screened or selected for highly functional variants are further characterized. In some embodiments, further characterizing the DME library comprises analyzing DME variants individually through sequencing, such as Sanger sequencing, to identify the specific mutation or mutations that gave rise to the highly functional variant. Individual mutant variants of the biomolecule can be isolated through standard molecular biology techniques for later analysis of function. In some embodiments, further characterizing the DME library comprises high throughput sequencing of both the naive library and the one or more libraries of highly functional variants. This approach may, in some embodiments, allow for the rapid identification of mutations that are over-represented in the one or more libraries of highly functional variants compared to the naïve DME library. Without wishing to be bound by any theory, mutations that are over-represented in the one or more libraries of highly functional variants are likely to be responsible for the activity of the highly functional variants. In some embodiments, further characterizing the DME library comprises both sequencing of individual variants and high throughput sequencing of both the naive library and the one or more libraries of highly functional variants.

High throughput sequencing can produce high throughput data indicating the functional effect of the library members. In embodiments wherein one or more libraries represents every possible mutation of every monomer location, such high throughput sequencing can evaluate the functional effect of every possible DME mutation. Such sequencing can also be used to evaluate one or more highly functional sub-populations of a given library, which in some embodiments may lead to identification of mutations that result in improved function. An exemplary protocol for high throughput sequencing of a library with a highly functional sub-population is as follows:
(1) High throughput sequencing of the Naive DME library, N. High throughput sequence the highly functional sub-population library, F. Any high throughput sequencing platform that can generate a suitable abundance of reads can be used. Exemplary sequencing platforms include, but are not limited to Illumina, Ion Torrent, 454 and PacBio sequencing platforms.
(2) Select a particular mutation to evaluate, i. Calculate the total fractional abundance of i in N, i(N). Calculate the total fractional abundance of i in F, i(F).
(3) Calculate the following: [(i(F)+1)/(i(N)+1)]. This value, the 'enrichment ratio', is correlated with the function of the particular mutant variant i of the biomolecule.
(4) Calculate the enrichment ratio for each of the mutations observed in deep sequencing of the DME libraries.
(5) The set of enrichment ratios for the entire library can be converted to a log scale such that a value of zero represents no enrichment (i.e. an enrichment ratio of one), values greater than zero represent enrichment, and values less than zero represent depletion. Alternatively, the log scale can be set such that 1.5 represents enrichment, and −0.6 represents depletion, as in FIG. 3A, FIG. 3B, FIG. 4A, FIG. 4C. These rescaled values can be referred to as the relative 'fitness' of any particular mutation. These fitness values quantitatively indicate the effect a particular mutation has on the biochemical function of the biomolecule.
(6) The set of calculated DME fitness values can be mapped to visually represent the fitness landscape of all possible mutations to a biomolecule. The fitness values can also be rank ordered to determine the most beneficial mutations contained within the DME library.

e. Iterating DME

In some embodiments, a highly functional variant produced by DME has more than one mutation. For example, combinations of different mutations can in some embodiments produce optimized biomolecules whose function is further improved by the combination of mutations. In some embodiments, the effect of combining mutations on function of the biomolecule is linear. As used herein, a combination of mutations that is linear refers to a combination whose effect on function is equal to the sum of the effects of each individual mutation when assayed in isolation. In some embodiments, the effect of combining mutations on function of the biomolecule is synergistic. As used herein, a combination of mutations that is synergistic refers to a combination whose effect on function is greater than the sum of the effects of each individual mutation when assayed in isolation. Other mutations may exhibit additional unexpected nonlinear additive effects, or even negative effects. This phenomenon is known as epistasis.

Epistasis can be unpredictable, and is a significant source of variation when combining mutations. Epistatic effects can be addressed through additional high throughput experimental methods in DME library construction and assay. In some embodiments, the entire DME protocol can be iterated, returning to the library construction step and selecting only mutations identified as having desired effects (such as increased functionality) from an initial DME library screen. Thus, in some embodiments, DME library construction and screening is iterated, with one or more cycles focusing the library on a subset of mutations having desired effects. In such embodiments, layering of selected mutations may lead to improved variants. In some alternative embodiments, DME can be repeated with the full set of mutations, but targeting a novel, pre-mutated version of the biomolecule. For example, one or more highly functional variants identified in a first round of DME library construction, assay, and characterization can be used as the target plasmid for further rounds of DME using a broad, unfocused set of further mutations (such as every possible mutation, or a subset thereof), and the process repeated. Any number, type of iterations or combinations of iterations of DME are envisaged as within the scope of the disclosure.

f. Deep Mutational Scanning

In some embodiments, Deep Mutational Scanning (DMS) is used to identify CasX variant proteins with improved function. Deep mutational scanning assesses protein plasticity as it relates to function. In DMS methods, every amino acid of a protein is changed to every other amino acid and absolute protein function assayed. For example, every amino acid in a CasX protein can be changed to every other amino acid, and the mutated CasX proteins assayed for their ability to bind to or cleave DNA. Exemplary assays such as the CRISPRi assay or bacterial-based cleavage assays that can be used to characterize collections of DMS CasX variant proteins are described in Oakes et al. (2016) "Profiling of engineering hotspots identifies an allosteric CRISPR-Cas9 switch" Nat Biotechnol 34(6):646-51 and Liu et al. (2019) "CasX enzymes comprise a distinct family of RNA-guided genome editors" Nature doi.org/10.1038/s41586-019-0908; the contents of which are incorporated herein by reference.

In some embodiments, DMS is used to identify CasX proteins with improved DNA binding activity. In some embodiments, DNA binding activity is assayed using a CRISPRi assay. In a non-limiting, exemplary embodiment of a CRISPRi assay, cells expressing a fluorescent protein such as green fluorescent protein (GFP) or red fluorescent protein (RFP) are assayed using FACS to identify CasX variants capable of repressing expression of the fluorescent protein in a sgNA dependent fashion. In this example, a catalytically dead CasX (dCasX) is used to generate the collection of DMS mutants being assayed. The wild-type CasX protein binds to its cognate sgNA and forms a protein-RNA complex. The complex binds to specific DNA targets by Watson-Crick base pairing between the sgNA and the DNA target, in this case a DNA sequence encoding the fluorescent protein. In the case of wild-type CasX, the DNA will be cleaved due to the nuclease activity of the CasX protein. However, without wishing to be bound by theory, it is likely that dCasX is still able to form a complex with the sgNA and bind to specific DNA target. When targeting of dCasX occurs to the protein-coding region, it blocks RNA polymerase II and transcript initiation and/or elongation, leading to a reduction in fluorescent protein expression that can be detected by FACs.

In some embodiments, DMS is used to identify CasX proteins with improved DNA cleavage activity. Methods of assaying the DNA cleavage efficiency of CasX variant proteins will be apparent to one of ordinary skill in the art. For example, CasX proteins complexed with an sgNA with a spacer complementary to a particular target DNA sequence can be used to cleave the DNA target sequence in vitro or in vivo in a suitable cell type, and the frequency of insertions and deletions at the site of cleavage are assayed. Without wishing to be bound by theory, cleavage or nicking by CasX generates double-strand breaks in DNA, whose subsequent repair by the non-homologous end joining pathway (NHEJ) gives rise to small insertions or deletions (indels) at the site of the double-strand breaks. The frequency of indels at the site of CasX cleavage can be measured using high throughput or Sanger sequencing of the target sequence. Alternatively, or in addition, frequency of indel generation by CasX cleavage of a target sequence can be measured using mismatch assays such as T7 Endonuclease I (T7EI) or Surveyor mismatch assays.

In some embodiments, following DMS, a map of the genotypes of DMS mutants linked with their resulting phenotype (for example, a heat map) is generated and used to characterize fundamental principles of the protein. All possible mutations are characterized as leading to functional or nonfunctional protein products to establish that protein's functional landscape.

g. Error Prone PCR

In some embodiments, Error Prone PCR is used to generate CasX protein or sgNA scaffold variants with improved function. Polymerases that replicate DNA have different levels of fidelity. One way of introducing random mutations to a gene is through an error prone polymerase that will incorporate incorrect nucleotides at a range of frequencies. This frequency can be modulated depending on the desired outcome. In some embodiments, a polymerase and conditions for polymerase activity are selected that result in a frequency of nucleotide changes that produces an average of n 1-4 amino acid changes in a protein sequence. An exemplary error prone polymerase comprises Agilent's GeneMorphII kit. The GeneMorphII kit can be used to amplify a DNA sequence encoding a wild type CasX protein (for example, a protein of SEQ ID NO: 1, SEQ ID NO: 2 or SEQ ID NO: 3), according to the manufacturer's protocol, thereby subjecting the protein to unbiased random mutagenesis and generating a diverse population of CasX variant proteins. This diverse population of CasX variant proteins can then be assayed using the same assays described above for DMS to observe how changes in genotype relate to changes in phenotype.

h. Cassette Mutagenesis

In some embodiments, cassette mutagenesis is used to generate CasX variant protein or sgNA scaffold variants with improved function. Cassette mutagenesis takes advantage of unique restriction enzyme sites that are replaced by degenerative nucleotides to create small regions of high diversity in select areas of a gene of interest such as a CasX protein or sgNA scaffold. In an exemplary cassette mutagenesis protocol, restriction enzymes are used to cleave near the sequence targeted for mutagenesis on DNA molecule encoding a CasX protein or sgNA scaffold contained in a suitable vector. This step removes the sequence targeted for mutagenesis and everything between the restriction sites. Then, synthetic double stranded DNA molecules containing the desired mutation and ends that are complimentary to the restriction digest ends are ligated in place of the sequence that has been removed by restriction digest, and suitable cells, such as E. coli are transformed with the ligated vector. In some embodiments, cassette mutagenesis can be used to generate one or more specific mutations in a CasX protein or sgNA scaffold. In some embodiments, cassette mutagenesis can be used to generate a library of CasX variant proteins or sgNA scaffold variants that can be screened or selected for improved function using the methods described herein. For example, in using cassette mutagenesis to generate CasX variants, parts of the Non-Target Strand Binding (NTSB) domain can be replaced with a sequence of degenerate nucleotides. Sequences of degenerate nucleotides can be highly localized to regions of the CasX protein, for example regions of the NTSB that are of interest because of their highly mobile elements or their direct contacts with DNA. Libraries of CasX variant proteins generated via cassette mutagenesis can then be screened using the assays described herein for DME, DMS and error prone PCR and variants can be selected for improved function.

i. Random Mutagenesis

In some embodiments, random mutagenesis is used to generate CasX variant proteins or sgNA scaffold variants with improved function. Random mutagenesis is an unbiased way of changing DNA. Exemplary methods of random mutagenesis will be known to the person of ordinary skill in the art and include exposure to chemicals, UV light, X-rays or use of unstable cell lines. Different mutagenic agents produce different types of mutations, and the ordinarily skilled artisan will be able to select the appropriate agent to generate the desired type of mutations. For example, ethylmethanesulfonate (EMS) and N-ethyl-N-nitrosourea (ENU) can be used to generate single base pair changes, while X-rays often result in deletions and gross chromosomal rearrangements. UV light exposure produces dimers between adjacent pyrimidines in DNA, which can result in point mutations, deletions and rearrangements. Error prone cell lines can also be used to introduce mutations, for example on a plasmid comprising a CasX protein or sgNA scaffold of the disclosure. A population of DNA molecules encoding a CasX protein (for example, a protein of SEQ ID NO: 1, SEQ ID NO: 2 or SEQ ID NO: 3) or an sgNA scaffold can be exposed to a mutagen to generate collection of CasX variant proteins or sgNA scaffold variants, and these collections can be assayed for improved function using any of the assays described herein.

j. Staggered Extension Process (StEP)

In some embodiments, a staggered extension process (StEP) is used to generate CasX variant proteins or sgNA scaffold variants with improved function. Staggered extension process is a specialized PCR protocol that allows for the breeding of multiple variants of a protein during a PCR reaction. StEP utilizes a polymerase with low processivity, (for example Taq or Vent polymerase) to create short primers off of two or more different template strands with a significant level of sequence similarity. The short primers are then extended for short time intervals allowing for shuffling of the template strands. This method can also be used as a means to stack DME variants. Exemplary StEP protocols are described by Zhao, H. et al. (1998) "Molecular evolution by staggered extension process (StEP) in vitro recombination" Nature Biotechnology 16: 258-261, the contents of which are incorporated herein by reference in their entirety. StEP can be used to generate collections of CasX variant proteins or sgNA scaffold variants, and these collections can be assayed for improved function using any of the assays described herein.

k. Gene Shuffling

In some embodiments, gene shuffling is used to generate CasX variant proteins or sgNA scaffold variants with improved function. In some embodiments, gene shuffling is used to combine (sometimes referred to herein as "stack") variants produced through other methods described herein, such as plasmid recombineering. In an exemplary gene shuffling protocol, a DNase, for example DNase I, is used to shear a set of parent genes into pieces of 50-100 base pair (bp) in length. In some embodiments, these parent genes comprise CasX variant proteins with improved function created and isolated using the methods described herein. In some embodiments, these parent genes comprise sgNA scaffold variants with improved function created and isolated using the methods described herein. Dnase fragmentation is then followed by a polymerase chain reaction (PCR) without primers. DNA fragments with sufficient overlapping homologous sequence will anneal to each other and are then extended by DNA polymerase. If different fragments comprising different mutations anneal, the result is a new variant combining those two mutations. In some embodiments, PCR without primers is followed by PCR extension, and purification of shuffled DNA molecules that have reached the size of the parental genes (e.g., a sequence encoding a CasX protein or sgNA scaffold). These genes can then be amplified with another PCR, for example by adding PCR primers complementary to the 5' and 3' ends of gene undergoing shuffling. In some embodiments, the primers may have additional sequences added to their 5' ends, such as sequences for restriction enzyme recognition sites needed for ligation into a cloning vector.

l. Domain Swapping

In some embodiments, domain swapping is used to generate CasX variant proteins or sgNA scaffold variants with improved function. To generate CasX variant proteins, engineered domain swapping can be used to mix and match parts with other proteins and CRISPR molecules. For example, CRISPR proteins have conserved RuvC domains, so the CasX RuvC domain could be swapped for that of other CRISPR proteins, and the resulting protein assayed for improved DNA cleavage using the assays described herein. For sgNAs, the scaffold stem, extended stem or loops can be exchanged with structures found in other RNAs, for example the scaffold stem and extended stem of the sgNA can be exchanged with thermostable stem loops from other RNAs, and the resulting variant assayed for improved function using the assays described herein. In some embodiments, domain swapping can be used to insert new domains into the CasX protein or sgNA. In some exemplary embodiments where domain swapping is applied to a protein, the inserted domain comprises an entire second protein.

VII. Vectors

In some embodiments, provided herein are vectors comprising polynucleotides encoding the CasX variant proteins and sgNA or dgNA variants and, optionally, donor template polynucleotides, described herein. In some cases, the vectors are utilized for the expression and recovery of the CasX, gNA (and, optionally, the donor template) components of the gene editing pair. In other cases, the vectors are utilized for the delivery of the encoding polynucleotides to target cells for the editing of the target nucleic acid, as described more fully, below.

In some embodiments, provided herein are polynucleotides encoding the sgNA or dgNA variants described herein. In some embodiments, said polynucleotides are DNA. In other embodiments, said polynucleotides are RNA. In some embodiments, provided herein are vectors comprising the polynucleotides sequences encoding the sgNA or dgNA variants described herein. In some embodiments, the vectors comprising the polynucleotides include bacterial plasmids, viral vectors, and the like. In some embodiments, a CasX variant protein and a sgNA variant are encoded on the same vector. In some embodiments, a CasX variant protein and a sgNA variant are encoded on different vectors.

In some embodiments, the disclosure provides a vector comprising a nucleotide sequence encoding the components of the CasX:gNA system. For example, in some embodiments provided herein is a recombinant expression vector comprising a) a nucleotide sequence encoding a CasX variant protein; and b) a nucleotide sequence encoding a gNA variant described herein. In some cases, the nucleotide sequence encoding the CasX variant protein and/or the nucleotide sequence encoding the gNA variant are operably linked to a promoter that is operable in a cell type of choice (e.g., a prokaryotic cell, a eukaryotic cell, a plant cell, an animal cell, a mammalian cell, a primate cell, a rodent cell, a human cell). Suitable promoters for inclusion in the vectors are described herein, below.

In some embodiments, the nucleotide sequence encoding the CasX variant protein is codon optimized. This type of optimization can entail a mutation of a CasX-encoding nucleotide sequence to mimic the codon preferences of the intended host organism or cell while encoding the same protein. Thus, the codons can be changed, but the encoded protein remains unchanged. For example, if the intended target cell was a human cell, a human codon-optimized CasX variant-encoding nucleotide sequence could be used. As another non-limiting example, if the intended host cell were a mouse cell, then a mouse codon-optimized CasX variant-encoding nucleotide sequence could be generated. As another non-limiting example, if the intended host cell were a plant cell, then a plant codon-optimized CasX variant protein-encoding nucleotide sequence could be generated. As another non-limiting example, if the intended host cell were a bacterial cell, then a bacterial codon-optimized CasX variant protein-encoding nucleotide sequence could be generated.

In some embodiments, provided herein are one or more recombinant expression vectors such as (i) a nucleotide sequence of a donor template nucleic acid wherein the donor template comprises a nucleotide sequence having homology to a target sequence of a target nucleic acid (e.g., a target genome); (ii) a nucleotide sequence that encodes a gNA or a gNA variant as described herein, that may be provided in a single-guide or dual-guide form, (e.g., operably linked to a promoter that is operable in a target cell such as a eukaryotic cell); and (iii) a nucleotide sequence encoding a CasX protein or a CasX variant protein (e.g., operably linked to a promoter that is operable in a target cell such as a eukaryotic cell). In some embodiments, the sequences encoding the gNA and CasX proteins are in different recombinant expression vectors, and in other embodiments the gNA and CasX proteins are in the same recombinant expression vector. In some embodiments, the sequences encoding the gNA, the CasX protein, and the donor template(s) are in different recombinant expression vectors, and in other embodiments one or more are in the same recombinant expression vector. In some embodiments, either the sgNA in the recombinant expression vector, the CasX protein encoded by the recombinant expression vector, or both, are variants of a reference CasX protein or gNAs as described herein. In the case of the nucleotide sequence encoding the gNA, the recombinant expression vector can be transcribed in vitro, for example using T7 promoter regulatory sequences and T7 polymerase in order to produce the gRNA, which can then be recovered by conventional methods; e.g., purification via gel electrophoresis. Once synthesized, the gRNA may be utilized in the gene editing pair to directly contact a target DNA or may be introduced into a cell by any of the well-known techniques for introducing nucleic acids into cells (e.g., microinjection, electroporation, transfection, etc.).

Depending on the host/vector system utilized, any of a number of suitable transcription and translation control elements, including constitutive and inducible promoters, transcription enhancer elements, transcription terminators, etc. may be used in the expression vector.

In some embodiments, a nucleotide sequence encoding a reference or variant CasX and/or gNA is operably linked to a control element; e.g., a transcriptional control element, such as a promoter. In some embodiments, a nucleotide sequence encoding a reference or CasX variant protein is operably linked to a control element; e.g., a transcriptional control element, such as a promoter. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., hematopoietic stem cells (e.g., mobilized peripheral blood (mPB) CD34(+) cell, bone marrow (BM) CD34(+) cell, etc.). By transcriptional activation, it is intended that transcription will be increased above basal levels in the target cell by 10 fold, by 100 fold, more usually by 1000 fold.

Non-limiting examples of eukaryotic promoters (promoters functional in a eukaryotic cell) include EF1alpha, EF1alpha core promoter, those from cytomegalovirus (CMV) immediate early, herpes simplex virus (HSV) thymidine kinase, early and late SV40, long terminal repeats (LTRs) from retrovirus, and mouse metallothionein-I. Further non-limiting examples of eukaryotic promoters include the CMV promoter full-length promoter, the minimal CMV promoter, the chicken β-actin promoter, the hPGK promoter, the HSV TK promoter, the Mini-TK promoter, the human synapsin I promoter which confers neuron-specific expression, the Mecp2 promoter for selective expression in neurons, the minimal IL-2 promoter, the Rous sarcoma virus enhancer/promoter (single), the spleen focus-forming virus long terminal repeat (LTR) promoter, the SV40 promoter, the SV40 enhancer and early promoter, the TBG promoter: promoter from the human thyroxine-binding globulin gene (Liver specific), the PGK promoter, the human ubiquitin C promoter, the UCOE promoter (Promoter of HNRPA2B1-CBX3), the Histone H2 promoter, the Histone H3 promoter, the U1a1 small nuclear RNA promoter (226 nt), the U1b2 small nuclear RNA promoter (246 nt) 26, the TTR minimal enhancer/promoter, the b-kinesin promoter, the human eIF4A1 promoter, the ROSA26 promoter and the Glyceraldehyde 3-phosphate dehydrogenase (GAPDH) promoter.

Selection of the appropriate vector and promoter is well within the level of ordinary skill in the art. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, fluorescent protein, etc.) that can be fused to the CasX protein, thus resulting in a chimeric CasX polypeptide.

In some embodiments, a nucleotide sequence encoding a gNA variant and/or a CasX variant protein is operably linked to a promoter that is an inducible promoter (i.e., a promoter whose state, active/"ON" or inactive/"OFF", is controlled by an external stimulus, e.g., the presence of a particular temperature, compound, or protein) or a promoter that is a constitutively active promoter (i.e., a promoter that is constitutively in an active/"ON" state). In other embodiments, a nucleotide sequence encoding a gNA variant and/or a CasX variant protein is operably linked to a spatially restricted promoter (i.e., transcriptional control element, enhancer, tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

In certain embodiments, suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6), an enhanced U6 promoter, a human HI promoter (HI), a POL1 promoter, a 7SK promoter, tRNA promoters and the like.

In some embodiments, a nucleotide sequence encoding a gNA is operably linked to (under the control of) a promoter operable in a eukaryotic cell (e.g., a U6 promoter, an enhanced U6 promoter, an HI promoter, and the like). As would be understood by one of ordinary skill in the art, when expressing an RNA (e.g., a gRNA) from a nucleic acid (e.g., an expression vector) using a U6 promoter (e.g., in a eukaryotic cell), or another PolIII promoter, the RNA may need to be mutated if there are several Ts in a row (coding for Us in the RNA). This is because a string of Ts (e.g., 5 Ts) in DNA can act as a terminator for polymerase III (Pol III). Thus, in order to ensure transcription of a gRNA (e.g., the activator portion and/or targeter portion, in dual guide or single guide format) in a eukaryotic cell, it may sometimes be necessary to modify the sequence encoding the gRNA to eliminate runs of Ts. In some cases, a nucleotide sequence encoding a CasX protein (e.g., a wild type CasX protein, a nickase CasX protein, a dCasX protein, a chimeric CasX protein and the like) is operably linked to a promoter operable in a eukaryotic cell (e.g., a CMV promoter, an EF1alpha promoter, an estrogen receptor-regulated promoter, and the like).

In certain embodiments, inducible promoters suitable for use may include any inducible promoter described herein or known to one of ordinary skill in the art. Examples of inducible promoters include, without limitation, T7 RNA polymerase promoter, T3 RNA polymerase promoter, isopropyl-beta-D-thiogalactopyranoside (IPTG)-regulated promoter, lactose induced promoter, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used as long as the promoter is functional in the targeted host cell (e.g., eukaryotic cell; prokaryotic cell).

In some cases, the promoter is a reversible promoter. Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including Tet Activators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Recombinant expression vectors of the disclosure can also comprise elements that facilitate robust expression of reference or CasX variant proteins and/or reference or variant gNAs of the disclosure. For example, recombinant expression vectors can include one or more of a polyadenylation signal (PolyA), an intronic sequence or a post-transcriptional regulatory element such as a woodchuck hepatitis post-transcriptional regulatory element (WPRE). Exemplary polyA sequences include hGH poly(A) signal (short), HSV TK poly(A) signal, synthetic polyadenylation signals, SV40 poly(A) signal, β-globin poly(A) signal and the like. In addition, vectors used for providing a nucleic acid encoding a gNA and/or a CasX protein to a cell may include nucleic acid sequences that encode for selectable markers in the target cells, so as to identify cells that have taken up the gNA and/or CasX protein. A person of ordinary skill in the art will be able to select suitable elements to include in the recombinant expression vectors described herein.

A recombinant expression vector sequence can be packaged into a virus or virus-like particle (also referred to herein as a "particle" or "virion") for subsequent infection and transformation of a cell, ex vivo, in vitro or in vivo. Such particles or virions will typically include proteins that encapsidate or package the vector genome. In some embodiments, a recombinant expression vector of the present disclosure is a recombinant adeno-associated virus (AAV) vector. In some embodiments, a recombinant expression vector of the present disclosure is a recombinant lentivirus vector. In some embodiments, a recombinant expression vector of the present disclosure is a recombinant retroviral vector.

Adeno-associated virus (AAV) is a small (20 nm), non-pathogenic virus that is useful in treating human diseases in situations that employ a viral vector for delivery to a cell such as a eukaryotic cell, either in vivo or ex vivo for cells to be prepared for administering to a subject. A construct is generated, for example a construct encoding any of the CasX proteins and/or gNA embodiments as described herein, and is flanked with AAV inverted terminal repeat (ITR) sequences, thereby enabling packaging of the AAV vector into an AAV viral particle.

An "AAV" vector may refer to the naturally occurring wild-type virus itself or derivatives thereof. The term covers all subtypes, serotypes and pseudotypes, and both naturally occurring and recombinant forms, except where required otherwise. As used herein, the term "serotype" refers to an AAV which is identified by and distinguished from other AAVs based on capsid protein reactivity with defined antisera, e.g., there are many known serotypes of primate AAVs. In some embodiments, the AAV vector is selected from AAV1, AAV2, AAV3, AAV4, AAV5, AAV6, AAV7, AAV8, AAV9, AAV 10, AAV-Rh74 (Rhesus macaque-derived AAV), and AAVRh10, and modified capsids of these serotypes. For example, serotype AAV-2 is used to refer to an AAV which contains capsid proteins encoded from the cap gene of AAV-2 and a genome containing 5' and 3' ITR sequences from the same AAV-2 serotype. Pseudotype AAV refers to an AAV that contains capsid proteins from one serotype and a viral genome including 5'-3' ITRs of a second serotype. Pseudotyped rAAV would be expected to have cell surface binding properties of the capsid serotype and genetic properties consistent with the ITR serotype. Pseudotyped recombinant AAV (rAAV) are produced using standard techniques described in the art. As used herein, for example, rAAV1 may be used to refer an AAV having both capsid proteins and 5'-3' ITRs from the same serotype or it may refer to an AAV having capsid proteins from serotype 1 and 5'-3' ITRs from a different AAV serotype, e.g., AAV serotype 2. For each example illustrated herein the description of the vector design and production describes the serotype of the capsid and 5'-3' ITR sequences.

An "AAV virus" or "AAV viral particle" refers to a viral particle composed of at least one AAV capsid protein (preferably by all of the capsid proteins of a wild-type AAV) and an encapsidated polynucleotide. If the particle additionally comprises a heterologous polynucleotide (i.e., a polynucleotide other than a wild-type AAV genome to be delivered to a mammalian cell), it is typically referred to as "rAAV". An exemplary heterologous polynucleotide is a polynucleotide comprising a CasX protein and/or sgRNA and, optionally, a donor template of any of the embodiments described herein.

By "adeno-associated virus inverted terminal repeats" or "AAV ITRs" is meant the art recognized regions found at each end of the AAV genome which function together in cis as origins of DNA replication and as packaging signals for the virus. AAV ITRs, together with the AAV rep coding region, provide for the efficient excision and rescue from, and integration of a nucleotide sequence interposed between two flanking ITRs into a mammalian cell genome. The nucleotide sequences of AAV ITR regions are known. See, for example Kotin, R. M. (1994) Human Gene Therapy 5:793-801; Berns, K. I. "Parvoviridae and their Replication" in Fundamental Virology, $2^{nd}$ Edition, (B. N. Fields and D. M. Knipe, eds.). As used herein, an AAV ITR need not have the wild-type nucleotide sequence depicted, but may be altered, e.g., by the insertion, deletion or substitution of nucleotides. Additionally, the AAV ITR may be derived from any of several AAV serotypes, including without limitation, AAV1, AAV2, AAV3, AAV4, AAV5, AAV6, AAV7, AAV8, AAV9, AAV10, AAV-Rh74, and AAVRh10, and modified capsids of these serotypes. Furthermore, 5' and 3' ITRs which flank a selected nucleotide sequence in an AAV vector need not necessarily be identical or derived from the same AAV serotype or isolate, so long as they function as intended, i.e., to allow for excision and rescue of the sequence of interest from a host cell genome or vector, and to allow integration of the heterologous sequence into the recipient cell genome when AAV Rep gene products are present in the cell. Use of AAV serotypes for integration of heterologous sequences into a host cell is known in the art (see, e.g., WO2018195555A1 and US20180258424A1, incorporated by reference herein.).

By "AAV rep coding region" is meant the region of the AAV genome which encodes the replication proteins Rep 78, Rep 68, Rep 52 and Rep 40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome. By "AAV cap coding region" is meant the region of the AAV genome which encodes the capsid proteins VP1, VP2, and VP3, or functional homologues thereof. These Cap expression products supply the packaging functions which are collectively required for packaging the viral genome.

In some embodiments, AAV capsids utilized for delivery of the encoding sequences for the CasX and gNA, and, optionally, the donor template nucleotides to a host cell can be derived from any of several AAV serotypes, including without limitation, AAV1, AAV2, AAV3, AAV4, AAV5, AAV6, AAV7, AAV8, AAV9, AAV10, AAV-Rh74 (Rhesus macaque-derived AAV), and AAVRh10, and the AAV ITRs are derived from AAV serotype 2.

In order to produce rAAV viral particles, an AAV expression vector is introduced into a suitable host cell using known techniques, such as by transfection. Packaging cells are typically used to form virus particles; such cells include HEK293 cells (and other cells known in the art), which package adenovirus. A number of transfection techniques are generally known in the art; see, e.g., Sambrook et al. (1989) Molecular Cloning, a laboratory manual, Cold Spring Harbor Laboratories, New York. Particularly suitable transfection methods include calcium phosphate co-precipitation, direct microinjection into cultured cells, electroporation, liposome mediated gene transfer, lipid-mediated transduction, and nucleic acid delivery using high-velocity microprojectiles.

In some embodiments, host cells transfected with the above-described AAV expression vectors are rendered capable of providing AAV helper functions in order to replicate and encapsidate the nucleotide sequences flanked by the AAV ITRs to produce rAAV viral particles. AAV helper functions are generally AAV-derived coding sequences which can be expressed to provide AAV gene products that, in turn, function in trans for productive AAV replication. AAV helper functions are used herein to complement necessary AAV functions that are missing from the AAV expression vectors. Thus, AAV helper functions include one, or both of the major AAV ORFs (open reading frames), encoding the rep and cap coding regions, or functional homologues thereof. Accessory functions can be introduced into and then expressed in host cells using methods known to those of skill in the art. Commonly, accessory functions are provided by infection of the host cells with an unrelated helper virus. In some embodiments, accessory functions are provided using an accessory function vector. Depending on the host/vector system utilized, any of a number of suitable transcription and translation control elements, including constitutive and inducible promoters, transcription enhancer elements, transcription terminators, etc., may be used in the expression vector.

In other embodiments, retroviruses, for example, lentiviruses, may be suitable for use as vectors for delivery of the encoding nucleic acids of the CasX:gNA systems of the present disclosure. Commonly used retroviral vectors are "defective", e.g. unable to produce viral proteins required for productive infection, and may be referred to a virus-like particles (VLP). Rather, replication of the vector requires growth in a packaging cell line. To generate viral particles comprising nucleic acids of interest, the retroviral nucleic acids comprising the nucleic acid are packaged into VLP capsids by a packaging cell line. Different packaging cell lines provide a different envelope protein (ecotropic, amphotropic or xenotropic) to be incorporated into the capsid, this envelope protein determining the specificity of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art.

For non-viral delivery, vectors can also be delivered wherein the vector or vectors encoding the CasX variants and gNA are formulated in nanoparticles, wherein the nanoparticles contemplated include, but are not limited to nanospheres, liposomes, quantum dots, polyethylene glycol particles, hydrogels, and micelles. Lipid nanoparticles are generally composed of an ionizable cationic lipid and three or more additional components, such as cholesterol, DOPE, polylactic acid-co-glycolic acid, and a polyethylene glycol (PEG) containing lipid. In some embodiments, the CasX variants of the embodiments disclosed herein are formulated in a nanoparticle. In some embodiments, the nanoparticle comprises the gNA of the embodiments disclosed herein. In some embodiments, the nanoparticle comprises RNP of the CasX variant complexed with the gNA. In some embodiments, the system comprises a nanoparticle comprising nucleic acids encoding the CasX variants and the gNA and, optionally, a donor template nucleic acid. In some embodiments, the components of the CasX:gNA system are formulated in separate nanoparticles for delivery to cells or for administration to a subject in need thereof.

VIII. Applications

The CasX proteins, guides, nucleic acids, and variants thereof provided herein, as well as vectors encoding such components, are useful for various applications, including therapeutics, diagnostics, and research.

Provided herein are methods of cleaving a target DNA, comprising contacting the target DNA with a CasX protein and gNA pair. In some embodiments, the pair comprises a CasX variant protein and a gNA, wherein the CasX variant protein is a CasX variant of SEQ ID NO: 2 as described herein (e.g., a sequence of Tables 3, 8, 9, 10 and 12), and wherein the contacting results in cleavage and, optionally, editing of the target DNA. In other embodiments, the pair comprises a reference CasX protein and a gNA. In some embodiments, the gNA is a gNA variant of the disclosure (e.g., a sequence of SEQ ID NOS: 2101-2280), or a reference gRNA scaffold comprising SEQ ID NO: 5 or SEQ ID NO: 4, and further comprises a spacer that is complementary to the target DNA.

In yet further aspects, the disclosure provides methods of cleaving a target DNA, comprising contacting the target DNA with a CasX protein and gNA pair of any of the embodiments described herein, wherein the contacting results in cleavage and optionally editing of the target DNA. In some embodiments, the scaffold of the gNA variant comprises a sequence of SEQ ID NO: 2101-2280, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto, and further comprises a spacer that is complementary to the target DNA. In some embodiments, the CasX protein is a CasX variant protein of any of the embodiments described herein (e.g., a sequence of Tables 3, 8, 9, 10 and 12), or a reference CasX protein SEQ ID NO: 1, SEQ ID NO: 2, or SEQ ID NO: 3.

In some embodiments, the methods of editing a target DNA comprise contacting a target DNA with a CasX protein and gNA pair as described herein and a donor polynucleotide, sometimes referred to as a donor template. In some embodiments, CasX protein and gNA pairs generate site-specific double strand breaks (DSBs) or single strand breaks (SSBs) (e.g., when the CasX variant protein is a nickase) within double-stranded DNA (dsDNA) target nucleic acids, which are repaired either by non-homologous end joining (NHEJ), homology-directed repair (HDR), homology-independent targeted integration, micro-homology mediated end joining (MMEJ), single strand annealing (SSA) or base excision repair (BER). In some cases, contacting a target DNA with a gene editing pair occurs under conditions that are permissive for NHEJ, HDR, or MMEJ. Thus, in some cases, a method as provided herein includes contacting the target DNA with a donor polynucleotide (e.g., by introducing the donor polynucleotide into a cell), wherein the donor polynucleotide, a portion of the donor polynucleotide, a copy of the donor polynucleotide, or a portion of a copy of the donor polynucleotide integrates into the target DNA. For example, an exogenous donor template which may comprise a corrective sequence (or a deletion to knock-out the defective allele) to be integrated flanked by an upstream sequence and a downstream sequence is introduced into a cell. The upstream and downstream sequences relative to the cleavage site(s) share sequence similarity with either side of the site of integration in the target DNA (i.e., homologous arms), facilitating the insertion. In other cases, an exogenous donor template which may comprise a corrective sequence is inserted between the ends generated by CasX cleavage by homology-independent targeted integration (HITI) mechanisms. The exogenous sequence inserted by HITI can be any length, for example, a relatively short sequence of between 1 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity. In some cases, the method does not comprise contacting a cell with a donor polynucleotide, and the target DNA is modified such that nucleotides within the target DNA are deleted or inserted according to the cells own repair pathways.

The donor template sequence may comprise certain sequence differences as compared to the genomic sequence, e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or in some cases may be used for other purposes (e.g., to signify expression at the targeted genomic locus). Alternatively, these sequence differences may include flanking recombination sequences such as FLPs, loxP sequences, or the like, that can be activated at a later time for removal of the marker sequence. In some embodiments of the method, the donor polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least 15,000 nucleotides of a wild-type gene. In other embodiments, the donor polynucleotide comprises at least about 10 to about 15,000 nucleotides, or at least about 200 to about 10,000 nucleotides, or at least about 400 to about 6000 nucleotides, or at least about 600 to about 4000 nucleotides, or at least about 1000 to about 2000 nucleotides of a wild-type gene. In some embodiments, the donor template is a single stranded DNA template or a single stranded RNA template. In other embodiments, the donor template is a double stranded DNA template.

In some embodiments, contacting the target DNA with a CasX protein and gNA gene editing pair of the disclosure results in gene editing. In some embodiments, the editing occurs in vitro, outside of a cell, in a cell-free system. In some embodiments, the editing occurs in vitro, inside of a cell, for example in a cell culture system. In some embodiments, the editing occurs in vivo inside of a cell, for example in a cell in an organism. In some embodiments, the cell is a eukaryotic cell. Exemplary eukaryotic cells may include cells selected from the group consisting of a plant cell, a fungal cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a pig cell, a dog cell, a primate cell, a non-human primate cell, and a human cell. In some embodiments, the cell is a human cell. In some embodiments, the cell is an embryonic stem cell, an induced pluripotent stem cell, a germ cell, a fibroblast, an oligodendrocyte, a glial cell, a hematopoietic stem cell, a neuron progenitor cell, a neuron, a muscle cell, a bone cell, a hepatocyte, a pancreatic cell, a retinal cell, a cancer cell, a T-cell, a B-cell, an NK cell, a fetal cardiomyocyte, a myofibroblast, a mesenchymal stem cell, an autotransplated expanded cardiomyocyte, an adipocyte, a totipotent cell, a pluripotent cell, a blood stem cell, a myoblast, an adult stem cell, a bone marrow cell, a mesenchymal cell, a parenchymal cell, an epithelial cell, an endothelial cell, a mesothelial cell, fibroblasts, osteoblasts, chondrocytes, exogenous cell, endogenous cell, stem cell, hematopoietic stem cell, bone-marrow derived progenitor cell, myocardial cell, skeletal cell, fetal cell, undifferentiated cell, multi-potent progenitor cell, unipotent progenitor cell, a monocyte, a cardiac myoblast, a skeletal myoblast, a macrophage, a capillary endothelial cell, a xenogenic cell, an allogenic cell, or a post-natal stem cell. In alternative embodiments, the cell is a prokaryotic cell.

Methods of editing of the disclosure can occur in vitro outside of a cell, in vitro inside of a cell or in vivo inside of a cell. The cell can be in a subject. In some embodiments, editing occurs in the subject having a mutation in an allele of a gene wherein the mutation causes a disease or disorder in the subject. In some embodiments, editing changes the mutation to a wild type allele of the gene. In some embodiments, editing knocks down or knocks out expression of an allele of a gene causing a disease or disorder in the subject. In some embodiments, editing occurs in vitro inside of the cell prior to introducing the cell into a subject. In some embodiments, the cell is autologous or allogeneic.

Methods of introducing a nucleic acid (e.g., a nucleic acid comprising a donor polynucleotide sequence, one or more nucleic acids encoding a CasX protein and/or a gNA, or variants thereof as described herein) into a cell are known in the art, and any convenient method can be used to introduce a nucleic acid (e.g., an expression construct such as an AAV or virus like particle (VLP; e.g. a capsid derived from one or more components of a retrovirus, described supra) vector comprising the encoded CasX and gNA components, as described, supra) into a cell. Suitable methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, direct addition by cell penetrating CasX proteins that are fused to or recruit donor DNA, cell squeezing, calcium phosphate precipitation, direct microinjection, nanoparticle-mediated nucleic acid delivery, and the like.

Introducing recombinant expression vectors into cells can occur in any suitable culture media and under any suitable culture conditions that promote the survival of the cells. Introducing recombinant expression vectors into a target cell can be carried out in vivo, in vitro or ex vivo.

In some embodiments, a CasX variant protein can be provided as RNA. The RNA can be provided by direct chemical synthesis, or may be transcribed in vitro from a DNA (e.g., a DNA encoding an mRNA comprising a sequence encoding the CasX variant protein). Once synthesized, the RNA may, for example, be introduced into a cell by any of the well-known techniques for introducing nucleic acids into cells (e.g., microinjection, electroporation, transfection).

Nucleic acids may be provided to the cells using well-developed transfection techniques, and the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like.

In some embodiments, vectors may be provided directly to a target host cell. For example, cells may be contacted with vectors comprising the subject nucleic acids (e.g., recombinant expression vectors having the donor template sequence and encoding the gNA variant; recombinant expression vectors encoding the CasX variant protein) such that the vectors are taken up by the cells. Methods for contacting cells with nucleic acid vectors that are plasmids include electroporation, calcium chloride transfection, microinjection, and lipofection are well known in the art. For viral vector delivery, cells can be contacted with viral particles comprising the subject viral expression vectors; e.g., the vectors are viral particles such as AAV or VLP that comprise polynucleotides that encode the CasX:gNA components or that comprise CasX:gNA RNP. For non-viral delivery, vectors or the CasX:gNA components can also be formulated for delivery in nanoparticles, wherein the nanoparticles contemplated include, but are not limited to nanospheres, liposomes, quantum dots, polyethylene glycol particles, hydrogels, and micelles.

A nucleic acid comprising a nucleotide sequence encoding a CasX variant protein is in some cases an RNA. Thus, in some embodiments a CasX variant protein can be introduced into cells as RNA. Methods of introducing RNA into cells are known in the art and may include, for example, direct injection, transfection, or any other method used for the introduction of DNA. A CasX variant protein may instead be provided to cells as a polypeptide. Such a polypeptide may optionally be fused to a polypeptide domain that increases solubility of the product. The domain may be linked to the polypeptide through a defined protease cleavage site, e.g. a TEV sequence, which is cleaved by TEV protease. The linker may also include one or more flexible sequences, e.g. from 1 to 10 glycine residues. In some embodiments, the cleavage of the fusion protein is performed in a buffer that maintains solubility of the product, e.g. in the presence of from 0.5 to 2 M urea, in the presence of polypeptides and/or polynucleotides that increase solubility, and the like. Domains of interest may include endosomolytic domains, e.g. influenza HA domain; and other polypeptides that aid in production, e.g. IF2 domain, GST domain, GRPE domain, and the like. The polypeptide may be formulated for improved stability. For example, the peptides may be PEGylated, where the polyethyleneoxy group provides for enhanced lifetime in the blood stream.

Additionally or alternatively, a reference or CasX variant protein of the present disclosure may be fused to a polypeptide permeant domain to promote uptake by the cell. A number of permeant domains are known in the art and may be used in the non-integrating polypeptides of the present disclosure, including peptides, peptidomimetics, and non-peptide carriers. For example, WO2017/106569 and US20180363009A1, incorporated by reference herein in its entirety, describe fusion of a Cas protein with one or more nuclear localization sequences (NLS) to facilitate cell uptake. In other embodiments, a permeant peptide may be derived from the third alpha helix of *Drosophila melanogaster* transcription factor Antennapaedia, referred to as penetratin, which comprises the amino acid sequence RQIKIWFQNRRMKWKK (SEQ ID NO: 398). As another example, the permeant peptide comprises the HIV-1 tat basic region amino acid sequence, which may include, for example, amino acids 49-57 of naturally-occurring tat protein. Other permeant domains include polyarginine motifs, for example, the region of amino acids 34-56 of HIV-1 rev protein, nona-arginine, octa-arginine, and the like. The site at which the fusion is made may be selected in order to optimize the biological activity, secretion or binding characteristics of the polypeptide. The optimal site will be determined by routine experimentation.

A CasX variant protein of the present disclosure may be produced in vitro or by eukaryotic cells or by prokaryotic cells transformed with encoding vectors (described above), and it may be further processed by unfolding, e.g. heat denaturation, dithiothreitol reduction, etc. and may be further refolded, using methods known in the art. In the case of production of the gNA of the present disclosure, recombinant expression vectors encoding the gNA can be transcribed in vitro, for example using T7 promoter regulatory sequences and T7 polymerase in order to produce the gRNA, which can then be recovered by conventional methods; e.g., purification via gel electrophoresis. Once synthesized, the gRNA may be utilized in the gene editing pair to directly contact a target DNA or may be introduced into a cell by any of the well-known techniques for introducing nucleic acids into cells (e.g., microinjection, electroporation, transfection, etc.).

In some embodiments, modifications of interest that do not alter the primary sequence of the CasX variant protein may include chemical derivatization of polypeptides, e.g., acylation, acetylation, carboxylation, amidation, etc. Also included are modifications of glycosylation, e.g. those made by modifying the glycosylation patterns of a polypeptide during its synthesis and processing or in further processing steps; e.g. by exposing the polypeptide to enzymes which affect glycosylation, such as mammalian glycosylating or deglycosylating enzymes. Also embraced are sequences that have phosphorylated amino acid residues, e.g. phosphotyrosine, phosphoserine, or phosphothreonine.

In other embodiments, the present disclosure provides nucleic acids encoding a gNA variant or encoding a CasX variant and reference CasX proteins that have been modified using ordinary molecular biological techniques and synthetic chemistry so as to improve their resistance to proteolytic degradation, to change the target sequence specificity, to optimize solubility properties, to alter protein activity (e.g., transcription modulatory activity, enzymatic activity, etc.) or to render them more suitable. Analogs of such polypeptides include those containing residues other than naturally occurring L-amino acids, e.g. D-amino acids or non-naturally occurring synthetic amino acids. D-amino acids may be substituted for some or all of the amino acid residues.

A CasX variant protein of the disclosure may be prepared by in vitro synthesis, using conventional methods as known in the art. Various commercial synthetic apparatuses are available, for example, automated synthesizers by Applied Biosystems, Inc., Beckman, etc. By using synthesizers, naturally occurring amino acids may be substituted with unnatural amino acids. The particular sequence and the manner of preparation will be determined by convenience, economics, purity required, and the like. If desired, various groups may be introduced into the peptide during synthesis or during expression, which allow for linking to other molecules or to a surface. Thus cysteines can be used to make thioethers, histidines for linking to a metal ion complex, carboxyl groups for forming amides or esters, amino groups for forming amides, and the like.

A CasX variant protein of the disclosure may also be isolated and purified in accordance with conventional methods of recombinant synthesis. A lysate may be prepared of the expression host and the lysate purified using high performance liquid chromatography (HPLC), exclusion chromatography, gel electrophoresis, affinity chromatography, or other purification technique. For the most part, the compositions which are used will comprise 50% or more by weight of the desired product, more usually 75% or more by weight, preferably 95% or more by weight, and for therapeutic purposes, usually 99.5% or more by weight, in relation to contaminants related to the method of preparation of the product and its purification. Usually, the percentages will be based upon total protein. Thus, in some cases, a CasX polypeptide, or a CasX fusion polypeptide, of the present disclosure is at least 80% pure, at least 85% pure, at least 90% pure, at least 95% pure, at least 98% pure, or at least 99% pure (e.g., free of contaminants, non-CasX proteins or other macromolecules, etc.).

In some embodiments, to induce cleavage or any desired modification to a target nucleic acid (e.g., genomic DNA), or any desired modification to a polypeptide associated with target nucleic acid in an in vitro cell, the gNA variant and/or the CasX variant protein of the present disclosure and/or the donor template sequence, whether they be introduced as nucleic acids or polypeptides, are provided to the cells for about 30 minutes to about 24 hours, e.g., 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 7 days, e.g., every 1.5 days, every 2 days, every 3 days, or any other frequency from about every day to about every 7 days. The agent(s) may be provided to the subject cells one or more times, e.g. one time, twice, three times, or more than three times, and the cells allowed to incubate with the agent(s) for some amount of time following each contacting event; e.g., 16-24 hours, after which time the media is replaced with fresh media and the cells are cultured further.

In some embodiments, the disclosure provides methods of treating a disease in a subject in need thereof comprising modifying a gene in a cell of the subject, the modifying comprising: a) administering to the subject a CasX protein of any of the embodiments described herein and a gNA of any of the embodiments described herein wherein the targeting sequence of the gNA has a sequence that hybridizes with the target nucleic acid; b) a nucleic acid encoding the CasX protein and gNA of any of the embodiments described herein; c) a vector comprising the nucleic acids encoding the CasX and gNA; d) a VLP comprising a CasX:gNA RNP; or e) combinations thereof. In some embodiments of the method, the CasX protein and the gNA are associated together in a protein complex, for example a ribonuclear protein complex (RNP).

In other embodiments, the methods of treating a disease in a subject in need thereof comprise administering to the subject a) a CasX protein or a polynucleotide encoding a CasX protein, b) a guide nucleic acid (gNA) comprising a targeting sequence or a polynucleotide encoding a gNA wherein the targeting sequence of the gNA has a sequence that hybridizes with the target nucleic acid, and c) a donor template comprising at least a portion or the entirety of a gene to be modified.

In some embodiments of the method of treating a disease, wherein a vector is administered to the subject, the vector is administered at a dose of at least about $1 \times 10^9$ vector genomes (vg), at least about $1 \times 10^{10}$ vg, at least about $1 \times 10^{11}$ vg, at least about $1 \times 10^{12}$ vg, at least about $1 \times 10^{13}$ vg, at least about $1 \times 10^{14}$ vg, at least about $1 \times 10^{15}$ vg, or at least about $1 \times 10^{16}$ vg. The vector can be administered by a route of administration selected from the group consisting of intraparenchymal, intravenous, intra-arterial, intracerebroventricular, intracisternal, intrathecal, intracranial, intravitreal, subretinal, and intraperitoneal routes.

A number of therapeutic strategies have been used to design the compositions for use in the methods of treatment of a subject with a disease. In some embodiments, the invention provides a method of treatment of a subject having a disease, the method comprising administering to the subject a CasX:gNA composition or a vector of any of the embodiments disclosed herein according to a treatment regimen comprising one or more consecutive doses using a therapeutically effective dose. In exemplary embodiments the CasX:gNA composition comprises a CasX variant of any one of SEQ ID NOS: 247-337, 3301-3493, 3498-3501, 3505-3520, 3540-3549 and 4412-4415, or a vector encoding the same. In some embodiments of the treatment regimen, the therapeutically effective dose of the composition or vector is administered as a single dose. In other embodiments of the treatment regimen, the therapeutically effective dose is administered to the subject as two or more doses over a period of at least two weeks, or at least one month, or at least two months, or at least three months, or at least four months, or at least five months, or at least six months. In some embodiments of the treatment regiment, the effective doses are administered by a route selected from the group consisting of subcutaneous, intradermal, intraneural, intranodal, intramedullary, intramuscular, intralumbar, intrathecal, subarachnoid, intraventricular, intracapsular, intravenous, intralymphatical, intravitreal, subretinal, or intraperitoneal routes, wherein the administering method is injection, transfusion, or implantation.

In some embodiments of the methods of treatment of a subject with a disease, the method comprises administering to the subject a CasX:gNA composition as an RNP within a VLP disclosed herein according to a treatment regimen comprising one or more consecutive doses using a therapeutically effective dose.

In some embodiments, the administering of the therapeutically effective amount of a CasX:gNA modality, including a vector comprising a polynucleotide encoding a CasX protein and a guide nucleic acid, or the administering of a CasX-gNA composition disclosed herein, to knock down or knock out expression of a gene product to a subject with a disease leads to the prevention or amelioration of the underlying disease such that an improvement is observed in the subject, notwithstanding that the subject may still be afflicted with the underlying disease. In some embodiments, the administration of the therapeutically effective amount of the CasX-gNA modality leads to an improvement in at least one clinically-relevant parameter for a disease.

In embodiments in which two or more different targeting complexes are provided to the cell (e.g., two gNA comprising two or more different spacers that are complementary to different sequences within the same or different target nucleic acid), the complexes may be provided simultaneously (e.g. as two polypeptides and/or nucleic acids), or delivered simultaneously. Alternatively, they may be provided consecutively, e.g. the targeting complex being provided first, followed by the second targeting complex, etc. or vice versa.

To improve the delivery of a DNA vector into a target cell, the DNA can be protected from damage and its entry into the cell facilitated, for example, by using lipoplexes and polyplexes. Thus, in some cases, a nucleic acid of the present disclosure (e.g., a recombinant expression vector of the present disclosure) can be covered with lipids in an organized structure like a micelle, a liposome, or a lipid nanoparticle. When the organized structure is complexed with DNA it is called a lipoplex. There are three types of lipids, anionic (negatively-charged), neutral, or cationic (positively-charged). Lipoplexes that utilize cationic lipids have proven utility for gene transfer. Cationic lipids, due to their positive charge, naturally complex with the negatively charged DNA. Also as a result of their charge, they interact with the cell membrane. Endocytosis of the lipoplex then occurs, and the DNA is released into the cytoplasm. The cationic lipids also protect against degradation of the DNA by the cell.

Complexes of polymers with DNA are referred to as polyplexes. Most polyplexes consist of cationic polymers and their production is regulated by ionic interactions. One large difference between the methods of action of polyplexes and lipoplexes is that polyplexes cannot release their DNA load into the cytoplasm, so to this end, co-transfection with endosome-lytic agents (to lyse the endosome that is made during endocytosis) such as inactivated adenovirus must occur. However, this is not always the case; polymers such as polyethylenimine have their own method of endosome disruption as does chitosan and trimethylchitosan.

Dendrimers, a highly branched macromolecule with a spherical shape, may be also be used to genetically modify stem cells. The surface of the dendrimer particle may be functionalized to alter its properties. In particular, it is possible to construct a cationic dendrimer (i.e., one with a positive surface charge). When in the presence of genetic material such as a DNA plasmid, charge complementarity leads to a temporary association of the nucleic acid with the cationic dendrimer. On reaching its destination, the dendrimer-nucleic acid complex can be taken up into a cell by endocytosis.

In some cases, a nucleic acid of the disclosure (e.g., an expression vector) includes an insertion site for a guide sequence of interest. For example, a nucleic acid can include an insertion site for a guide sequence of interest, where the insertion site is immediately adjacent to a nucleotide sequence encoding the portion of a gNA variant (e.g. the scaffold region) that does not change when the guide sequence is changed to hybridize to a desired target sequence. Thus, in some cases, an expression vector includes a nucleotide sequence encoding a gNA, except that the portion encoding the spacer sequence portion of the gNA is an insertion sequence (an insertion site). An insertion site is any nucleotide sequence used for the insertion of a spacer in the desired sequence. "Insertion sites" for use with various technologies are known to those of ordinary skill in the art and any convenient insertion site can be used. An insertion site can be for any method for manipulating nucleic acid sequences. For example, in some cases the insertion site is a multiple cloning site (MCS) (e.g., a site including one or more restriction enzyme recognition sequences), a site for ligation independent cloning, a site for recombination based cloning (e.g., recombination based on att sites), a nucleotide sequence recognized by a CRISPR/Cas (e.g. Cas9) based technology, and the like.

IX. Cells

In still further embodiments, provided herein are cells comprising components of any of the CasX:gNA systems described herein. In some embodiments, the cells comprise any of the gNA variant embodiments as described herein, or the reference gRNA of SEQ ID NO: 5 or SEQ ID NO: 4 and further comprises a spacer that is complementary to the target DNA. In some embodiments, the cells further comprise a CasX variant as described herein (e.g, the sequences of Tables 3, 8, 9, 10 and 12 or a reference CasX protein of SEQ ID NO: 1, SEQ ID NO: 2, or SEQ ID NO. 3). In other embodiments, the cells comprise RNP of any of the CasX:gNA embodiments described herein. In other embodiments, the disclosure provides cells comprising vectors encoding the CasX:gNA systems of any of the embodiments described herein. In still other embodiments, the cells comprise target DNA that has been edited by the CasX:gNA embodiments described herein; either to correct a mutation (knock-in) or to knock-down or knock-out a defective gene.

In some embodiments, the cell is a eukaryotic cell, for example a human cell. In alternative embodiments, the cell is a prokaryotic cell.

In some embodiments, the cell is a modified cell (e.g., a genetically modified cell) comprising nucleic acid comprising a nucleotide sequence encoding a CasX variant protein of the disclosure. In some embodiments, the genetically modified cell is genetically modified with an mRNA comprising a nucleotide sequence encoding a CasX variant protein. In some embodiments, the cell is genetically modified with a recombinant expression vector comprising: a) a nucleotide sequence encoding a CasX variant protein of the present disclosure; and b) a nucleotide sequence encoding a gNA of the disclosure, and, optionally, comprises a nucleotide sequence encoding a donor template. In some cases, such cells are used to produce the individual components or RNP of CasX:gNA systems for use in editing target DNA. In other cases, cells that have been genetically modified in this way may be administered to a subject for purposes such as gene therapy, e.g., to treat a disease or condition caused by a genetic mutation or defect.

A cell that can serve as a recipient for a CasX variant protein and/or gNA of the present disclosure and/or a nucleic acid comprising a nucleotide sequence encoding a CasX variant protein and/or a gNA variant, can be any of a variety of cells, including, e.g., in vitro cells; in vivo cells; ex vivo cells; primary cells; cells of an immortalized cell line; cancer cells; animal cells; plant cells; algal cells; fungal cells; etc. A cell can be a recipient of a CasX RNP of the present disclosure. A cell can be a recipient of a single component of a CasX system of the present disclosure. A cell can be a recipient of a vector encoding the CasX, gNA and, optionally, a donor template of the CasX:gNA systems of any of the embodiments described herein.

Non-limiting examples of cells that can serve as host cells for production of the CasX:gNA systems disclosed herein include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, cannabis, tobacco, flowering plants, conifers, gymnosperms, angiosperms, ferns, clubmosses, hornworts, liverworts, mosses, dicotyledons, monocotyledons, etc.), an algal cell, (e.g., *Botryococcus braunii, Chlamydomonas reinhardtii, Nannochloropsis gaditana, Chlorella pyrenoidosa, Sargassum patens, C. agardh*, and the like), seaweeds (e.g. kelp) a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., an ungulate (e.g., a pig, a cow, a goat, a sheep); a rodent (e.g., a rat, a mouse); a non-human primate; a human; a feline (e.g., a cat); a canine (e.g., a dog); etc.), and the like. In some cases, the cell is a cell that does not originate from a natural organism (e.g., the cell can be a synthetically made cell; also referred to as an artificial cell).

In certain embodiments, as provided herein, a cell can be an in vitro cell (e.g., established cultured cell line including, but not limited to HEK293 cells, HEK293T cells, HEK293-F cells, Lenti-X 293T cells, BHK cells, HepG2 cells, Saos-2 cells, HuH7 cells, A549 cells, NS0 cells, SP2/0 cells, YO myeloma cells, P3X63 mouse myeloma cells, PER cells, PER.C6 cells, hybridoma cells, VERO cells, NIH3T3 cells, COS, WI38 cells, MRC5 cells, HeLa, HT1080 cells, or CHO cells). A cell can be an ex vivo cell (cultured cell from an individual). Such cells can be autologous with respect to a subject to be administered said cell(s). In other embodiments, the cells can be allogeneic with respect to a subject to be administered said cell(s). A cell can be an in vivo cell (e.g., a cell in an individual). A cell can be an isolated cell. A cell can be a cell inside of an organism. A cell can be an organism. A cell can be a cell in a cell culture (e.g., in vitro cell culture). A cell can be one of a collection of cells. A cell can be a prokaryotic cell or derived from a prokaryotic cell. A cell can be a bacterial cell or can be derived from a bacterial cell. A cell can be an archaeal cell or derived from an archaeal cell. A cell can be a eukaryotic cell or derived from a eukaryotic cell. A cell can be a plant cell or derived from a plant cell. A cell can be an animal cell or derived from an animal cell. A cell can be an invertebrate cell or derived from an invertebrate cell. A cell can be a vertebrate cell or derived from a vertebrate cell. A cell can be a mammalian cell or derived from a mammalian cell. A cell can be a rodent cell or derived from a rodent cell. A cell can be a human cell or derived from a human cell. A cell can be a microbe cell or derived from a microbe cell. A cell can be a fungi cell or derived from a fungi cell. A cell can be an insect cell. A cell can be an arthropod cell. A cell can be a protozoan cell. A cell can be a helminth cell.

Suitable cells may include, in some embodiments, a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic stem cell, a neuron progenitor cell, a neuron, a muscle cell, a bone cell, a hepatocyte, a pancreatic cell, a retinal cell, a cancer cell, a T-cell, a B-cell, a fetal cardiomyocyte, a myofibroblast, a mesenchymal stem cell, an autotransplated expanded cardiomyocyte, an adipocyte, a totipotent cell, a pluripotent cell, a blood stem cell, a myoblast, an adult stem cell, a bone marrow cell, a mesenchymal cell, a parenchymal cell, an epithelial cell, an endothelial cell, a mesothelial cell, fibroblasts, osteoblasts, chondrocytes, exogenous cell, endogenous cell, stem cell, hematopoietic stem cell, bone-marrow derived progenitor cell, myocardial cell, skeletal cell, fetal cell, undifferentiated cell, multi-potent progenitor cell, unipotent progenitor cell, a monocyte, a cardiac myoblast, a skeletal myoblast, a macrophage, a capillary endothelial cell, a xenogenic cell, an allogenic cell, and a post-natal stem cell.

In some embodiments, the cell is an immune cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg). In some cases, the cell expresses a chimeric antigen receptor.

In some embodiments, the cell is a stem cell. Stem cells may include, for example, adult stem cells. Adult stem cells can also be referred to as somatic stem cells. In some embodiments, the stem cell is a hematopoietic stem cell (HSC), neural stem cell or a mesenchymal stem cell. In other embodiments, the stem cell is a mesenchymal stem cell (MSC). MSCs originally derived from the embryonal mesoderm and isolated from adult bone marrow, can differentiate to form muscle, bone, cartilage, fat, marrow stroma, and tendon. Methods of isolating MSC are known in the art; and any known method can be used to obtain MSC.

A cell in some embodiments is an arthropod cell.

X. Kits and Articles of Manufacture

In another aspect, provided herein are kits comprising a CasX protein and one or a plurality of gNA of any of the embodiments of the disclosure and a suitable container (for example a tube, vial or plate). In some embodiments, the kit comprises a gNA variant of the disclosure, or the reference gRNA of SEQ ID NO: 5 or SEQ ID NO: 4. Exemplary gNA variants that can be included comprise a sequence of any one of SEQ ID NO: 2101-2280.

In some embodiments, the kit comprises a CasX variant protein of the disclosure (e.g. a sequence of Tables 3, 8, 9, 10 and 12), or the reference CasX protein of SEQ ID NO: 1, SEQ ID NO: 2, or SEQ ID NO: 3. In exemplary embodiments, a kit of the disclosure comprises a CasX variant of any one of SEQ ID NOS: 247-337, 3301-3493, 3498-3501, 3505-3520, 3540-3549 and 4412-4415. In some embodiments, the kit comprises a CasX variant of any one of SEQ ID NOS: 247-337, 3498-3501, 3505-3520, 3540-3549 and 4412-4415. In some embodiments, the kit comprises a CasX variant of any one of 3498-3501, 3505-3520, and 3540-3549.

In some embodiments, the kit comprises a gNA or a vector encoding a gNA, wherein the gNA comprises a sequence selected from the group consisting of SEQ ID NOS: 412-3295. In some embodiments, the gNA comprises a sequence selected from the group consisting of SEQ ID NOS: 2101-2280. In some embodiments, the gNA comprises a sequence selected from the group consisting of SEQ ID NOS: 2236, 2237, 2238, 2241, 2244, 2248, 2249, and 2259-2280.

In certain embodiments, provided herein are kits comprising a CasX protein and gNA editing pair comprising a CasX variant protein of Tables 3, 8, 9, 10 and 12 and a gNA variant as described herein (e.g., a sequence of Table 2). In exemplary embodiments, a kit of the disclosure comprises a CasX and gNA editing pair, wherein the CasX variant comprises of any one of SEQ ID NOS: 247-337, 3301-3493, 3498-3501, 3505-3520, 3540-3549 and 4412-4415. In some embodiments, the gNA of the gene editing pair comprises any one of SEQ ID NOS: 412-3295. In some embodiments, the gNA of the gene editing pair comprises any one of SEQ ID NOS: 2101-2280. In some embodiments, the gNA of the gene editing pair comprises any one of SEQ ID NOS: 2236, 2237, 2238, 2241, 2244, 2248, 2249, or 2259-2280.

In some embodiments, the kit further comprises a buffer, a nuclease inhibitor, a protease inhibitor, a liposome, a therapeutic agent, a label, a label visualization reagent, or any combination of the foregoing. In some embodiments, the kit further comprises a pharmaceutically acceptable carrier, diluent or excipient.

In some embodiments, the kit comprises appropriate control compositions for gene editing applications, and instructions for use.

In some embodiments, the kit comprises a vector comprising a sequence encoding a CasX variant protein of the disclosure, a gNA variant of the disclosure, optionally a donor template, or a combination thereof.

The present description sets forth numerous exemplary configurations, methods, parameters, and the like. It should be recognized, however, that such description is not intended as a limitation on the scope of the present disclosure, but is instead provided as a description of exemplary embodiments. Embodiments of the present subject matter described above may be beneficial alone or in combination, with one or more other aspects or embodiments. Without limiting the foregoing description, certain non-limiting embodiments of the disclosure are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiments explicitly provided below:

Embodiment Set #1

Embodiment 1. A variant of a reference CasX protein, wherein the CasX variant is capable of forming a complex with a guide nucleic acid, and wherein the complex binds a target nucleic acid, and wherein the CasX variant comprises at least one modification in at least one of the following domains of the reference CasX protein:
(a) a non-target strand binding (NTSB) domain that binds to the non-target strand of DNA, wherein the NTSB domain comprises a four-stranded beta sheet;
(b) a target strand loading (TSL) domain that places the target DNA in a cleavage site of the CasX variant, the TSL domain comprising three positively charged amino acids, wherein the three positively charged amino acids bind to the target strand of DNA,
(c) a helical I domain that interacts with both the target DNA and a spacer region of a guide RNA, wherein the helical I domain comprises one or more alpha helices;
(d) a helical II domain that interacts with both the target DNA and a scaffold stem of the guide RNA;
(e) an oligonucleotide binding domain (OBD) that binds a triplex region of the guide RNA; and
(f) a RuvC DNA cleavage domain; wherein the CasX variant exhibits at least one improved characteristic as compared to the reference CasX protein.

Embodiment 2. The CasX variant of Embodiment 1, wherein the reference CasX comprises the sequence of SEQ ID NO: 1, SEQ ID NO: 2, or SEQ ID NO: 3, or at least 60% similarity thereto.

Embodiment 3. The CasX variant of Embodiment 2, wherein the reference CasX comprises the sequence of SEQ ID NO: 1, or at least 60% similarity thereto.

Embodiment 4. The CasX variant of Embodiment 2, wherein the reference CasX comprises the sequence of SEQ ID NO: 2, or at least 60% similarity thereto.

Embodiment 5. The CasX variant of Embodiment 2, wherein the reference CasX comprises the sequence of SEQ ID NO: 3, or at least 60% similarity thereto.

Embodiment 6. The CasX variant of any one of Embodiment 1 to Embodiment 5, wherein the complex binds a target DNA and cleaves the target DNA.

Embodiment 7. The CasX variant of any one of Embodiment 1 to Embodiment 5, wherein the complex binds a target DNA but does not cleave the target DNA.

Embodiment 8. The CasX variant of any one of Embodiment 1 to Embodiment 5, wherein the complex binds a target DNA and generates a single stranded nick in the target DNA.

Embodiment 9. The CasX variant of any one of Embodiment 1 to Embodiment 8, wherein at least one modification comprises at least one amino acid substitution in a domain.

Embodiment 10. The CasX variant of any one of Embodiment 1 to Embodiment 9, wherein at least one modification comprises at least one amino acid deletion in a domain.

Embodiment 11. The CasX variant of Embodiment 10, wherein at least one modification comprises the deletion of 1 to 4 consecutive or non-consecutive amino acids in the protein.

Embodiment 12. The CasX variant of any one of Embodiment 1 to Embodiment 10, wherein modification comprises at least one amino acid insertion in a domain.

Embodiment 13. The CasX variant of Embodiment 12, wherein at least one modification comprises the insertion of 1 to 4 consecutive or non-consecutive amino acids in a domain.

Embodiment 14. The CasX variant of any one of 1 to Embodiment 13, having at least 60% similarity to one of SEQ ID NO: 1, SEQ ID NO: 2, or SEQ ID NO: 3.

Embodiment 15. The CasX variant of Embodiment 14, wherein the variant has at least 60% similarity sequence identity to SEQ ID NO: 2.

Embodiment 16. The CasX variant of any one of Embodiment 1 to Embodiment 15, wherein the improved characteristic is selected from the group consisting of improved folding of the variant, improved binding affinity to the guide RNA, improved binding affinity to the target DNA, altered binding affinity to one or more PAM sequences, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved protein:guide RNA complex stability, improved protein solubility, improved protein:guide RNA complex solubility, improved protein yield, and improved fusion characteristics.

Embodiment 17. The CasX variant of any one of Embodiment 1 to Embodiment 16, wherein at least one of the at least one improved characteristic of the CasX variant is at least about 1.1 to about 100,000 times improved relative to the reference protein.

Embodiment 18. The CasX variant of any one of Embodiment 1 to Embodiment 17, wherein at least one of the at least one improved characteristics of the CasX variant is at least about 10 to about 100 times improved relative to the reference protein.

Embodiment 19. The CasX variant any one of Embodiment 1 to Embodiment 18, wherein the CasX variant has about 1.1 to about 100 times increased binding affinity to the guide RNA compared to the protein of SEQ ID NO: 2.

Embodiment 20. The CasX variant any one of Embodiment 1 to Embodiment 19, wherein the CasX variant has about one to about two times increased binding affinity to the target DNA compared to the protein of SEQ ID NO: 1, SEQ ID NO: 2, or SEQ ID NO: 3.

Embodiment 21. The CasX variant of any one of Embodiment 1 to Embodiment 20, wherein the CasX protein comprises between 400 and 3000 amino acids.

Embodiment 22. The CasX variant of any one of Embodiment 1 to Embodiment 21, comprising at least one modification in at least two domains of the reference CasX protein.

Embodiment 23. The CasX variant of any one of Embodiment 1 to Embodiment 22, comprising two or more modifications in at least one domain of the reference CasX protein.

Embodiment 24. The CasX variant of any one of Embodiment 1 to Embodiment 23, wherein at least one modification comprises deletion of at least a portion of one domain of the reference CasX protein.

Embodiment 25. The CasX variant of any one of Embodiment 1 to Embodiment 24, comprising at least one modification of a region of non-contiguous residues that form a channel in which guide RNA:target DNA complexing occurs.

Embodiment 26. The CasX variant of any one of Embodiment 1 to Embodiment 25, comprising at least one modification of a region of non-contiguous residues that form an interface which binds with the guide RNA.

Embodiment 27. The CasX variant of any one of Embodiment 1 to Embodiment 26, comprising at least one modification of a region of non-contiguous residues that form a channel which binds with the non-target strand DNA.

Embodiment 28. The CasX variant of any one of Embodiment 1 to Embodiment 27, comprising at least one modification of a region of non-contiguous residues that form an interface which binds with the PAM.

Embodiment 29. The CasX variant of any one of Embodiment 1 to Embodiment 28, comprising at least one modification of a region of non-contiguous surface-exposed residues.

Embodiment 30. The CasX variant of any one of Embodiment 1 to Embodiment 29, comprising at least one modification of a region of non-contiguous residues that form a core through hydrophobic packing in a domain of the variant.

Embodiment 31. The CasX variant of any one of Embodiment 1 to Embodiment 30, wherein between 2 to 15 residues of the region are charged.

Embodiment 32. The CasX variant of any one of Embodiment 1 to Embodiment 31, wherein between 2 to 15 residues of the region are polar.

Embodiment 33. The CasX variant of any one of Embodiment 1 to Embodiment 32, wherein between 2 to 15 residues of the region stack with DNA or RNA bases.

Embodiment 34. A variant of a reference guide nucleic acid (NA) capable of binding a reference CasX protein, wherein:
the reference nucleic acid comprises a tracrNA sequence and a crNA sequence, wherein:
the tracrNA comprises a scaffold stem loop region comprising an bubble,
the tracrNA and the crNA form a stem and a triplex region, and
the tracrNA and the crNA are fused, and form a fusion stem loop region;
the variant comprises at least one modification to the reference guide NA, and
the variant exhibits at least one improved characteristic compared to the reference guide RNA.

Embodiment 35. The guide NA variant of Embodiment 34, comprising a tracrRNA stem loop comprising the sequence -UUU-N3-20-UUU-.

Embodiment 36. The guide NA variant of Embodiment 34 or Embodiment 35, comprising a crRNA sequence with -AAAG- in a location 5' to the spacer region.

Embodiment 37. The guide NA variant of Embodiment 36, wherein the -AAAG-sequence is immediately 5' to the spacer region.

Embodiment 38. The guide NA variant of any one of Embodiment 34 to Embodiment 37, wherein the at least one improved characteristic is selected from the group consisting of improved stability, improved solubility, improved resistance to nuclease activity, increased folding rate of the NA, decreased side product formation during folding, increased productive folding, improved binding affinity to a reference CasX protein, improved binding affinity to a target DNA, improved gene editing, and improved specificity.

Embodiment 39. The guide NA variant of any one of Embodiment 34 to Embodiment 37, wherein at least one modification comprises at least one nucleic acid substitution in a region.

Embodiment 40. The guide NA variant of any one of Embodiment 34 to Embodiment 39, wherein at least one modification comprises at least one nucleic acid deletion in a region.

Embodiment 41. The guide NA variant of Embodiment 40, wherein at least one modification comprises deletion of 1 to 4 nucleic acids in a region.

Embodiment 42. The guide NA variant of any one of Embodiment 34 to Embodiment 40, wherein at least one modification comprises at least one nucleic acid insertion in a region.

Embodiment 43. The guide NA variant of Embodiment 42, wherein at least one modification comprises insertion of 1 to 4 nucleic acids in a region.

Embodiment 44. The guide NA variant of any one of Embodiment 34 to Embodiment 42, comprising a scaffold region at least 60% homologous to SEQ ID NO: 5.

Embodiment 45. The guide NA variant of any one of Embodiment 34 to Embodiment 44, comprising a scaffold NA stem loop at least 60% homologous to SEQ ID NO: 6.

Embodiment 46. The guide NA variant of any one of Embodiment 34 to Embodiment 45, comprising an extended stem loop at least 60% homologous to SEQ ID NO: 7.

Embodiment 47. The guide NA variant of any one of Embodiment 34 to Embodiment 46, wherein the guide NA variant sequence is at least 20%, at least 30%, at least 40%, at least 50%, at least 60%, or at least 70% homologous to SEQ ID NO: 4.

Embodiment 48. The guide NA variant of any one of Embodiment 34 to Embodiment 47, comprising an extended stem loop region comprising fewer than 10,000 nucleotides.

Embodiment 49. The guide NA variant of any one of Embodiment 34 to Embodiment 44, wherein the scaffold stem loop or the extended stem loop is swapped for an exogenous stem loop.

Embodiment 50. The guide NA variant of any one of Embodiment 34 to Embodiment 49, further comprising a hairpin loop that is capable of binding a protein, RNA or DNA.

Embodiment 51. The guide NA variant of Embodiment 50, wherein the hairpin loop is from MS2, QB, U1A, or PP7.

Embodiment 52. The guide NA variant of any one of Embodiment 34 to Embodiment 48, further comprising one or more ribozymes.

Embodiment 53. The guide NA variant of Embodiment 52, wherein the one or more ribozymes are independently fused to a terminus of the guide RNA variant.

Embodiment 54. The guide NA variant of Embodiment 52 or Embodiment 53, wherein at least one of the one or more ribozymes are an hepatitis delta virus (HDV) ribozyme, hammerhead ribozyme, pistol ribozyme, hatchet ribozyme, or tobacco ringspot virus (TRSV) ribozyme.

Embodiment 55. The guide NA variant of any one of Embodiment 34 to Embodiment 54, further comprising a protein binding motif.

Embodiment 56. The guide NA variant of any one of Embodiment 34 to Embodiment 55, further comprising a thermostable stem loop.

Embodiment 57. The guide NA variant of Embodiment 34, comprising the sequence of any one of SEQ ID NO: 9 to SEQ ID NO: 66.

Embodiment 58. The guide NA variant of any one of Embodiment 34 to Embodiment 57, further comprising a spacer region.

Embodiment 59. The guide NA variant of any one of Embodiment 34 to Embodiment 58, wherein the reference guide RNA comprises SEQ ID NO: 5.

Embodiment 60. The guide NA variant of any one of Embodiment 38 to Embodiment 59, wherein the reference CasX protein comprises SEQ ID NO: 1, SEQ ID NO: 2, or SEQ ID NO: 3.

Embodiment 61. A gene editing pair comprising a CRISPR-associated protein (Cas protein) and a guide NA, wherein the Cas protein is a CasX variant of any one of Embodiment 1 to Embodiment 33.

Embodiment 62. The gene editing pair of 61, wherein the guide NA is a guide NA variant of any one of Embodiment 34 to Embodiment 60, or the guide NA of SEQ ID NO: 4 or SEQ ID NO: 5.

Embodiment 63. The gene editing pair of Embodiment 61 or Embodiment 62, wherein the gene editing pair has one or more improved characteristics compared to a gene editing pair comprising a CasX protein of SEQ ID NO: 1, SEQ ID NO: 2, or SEQ ID NO: 3; and a guide RNA of SEQ ID NO: 4 or SEQ ID NO: 5.

Embodiment 64. The gene editing pair of Embodiment 63, wherein the one or more improved characteristics comprises improved protein:guide NA complex stability, improved protein:guide NA complex stability, improved binding affinity between the protein and guide NA, improved kinetics of complex formation, improved binding affinity to the target DNA, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, or improved resistance to nuclease activity.

Embodiment 65. A gene editing pair comprising a CRISPR-associated protein (Cas protein) and a guide NA, wherein the guide NA is a guide NA variant of any one of Embodiment 34 to Embodiment 60.

Embodiment 66. The gene editing pair of Embodiment 65, wherein the Cas protein is a CasX variant of any one of Embodiment 1 to Embodiment 22, or a CasX protein of SEQ ID NO: 1, SEQ ID NO: 2, or SEQ ID NO. 3.

Embodiment 67. The gene editing pair of Embodiment 65 or Embodiment 66, wherein the gene editing pair has one or more improved characteristics.

Embodiment 68. The gene editing pair of Embodiment 67, wherein the one or more improved characteristics comprises improved protein:guide NA complex stability, improved protein:guide NA complex stability, improved binding affinity between the protein and guide NA, improved binding affinity to the target DNA, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, or improved resistance to nuclease activity.

Embodiment 69. A method of editing a target DNA, comprising combining the target DNA with a gene editing pair, the gene editing pair comprising a CasX variant and a guide RNA, wherein the CasX variant is a CasX variant of any one of Embodiment 1 to Embodiment 33, and wherein the combining results in editing of the target DNA.

Embodiment 70. The method of 69, wherein the guide NA is a guide NA variant of any one of Embodiment 34 to Embodiment 60, or the guide RNA of SEQ ID NO: 4 or SEQ ID NO: 5.

Embodiment 71. The method of Embodiment 69 or Embodiment 70, wherein editing occurs in vitro outside of a cell.

Embodiment 72. The method of Embodiment 69 or Embodiment 70, wherein editing occurs in vitro inside of a cell.

Embodiment 73. The method of Embodiment 69 or Embodiment 70, wherein editing occurs in vivo inside of a cell.

Embodiment 74. The method of any one of Embodiment 71 to Embodiment 73, wherein the cell is a eukaryotic cell.

Embodiment 75. The method of Embodiment 74, wherein the eukaryotic cell is selected from the group consisting of a plant cell, a fungal cell, a protist cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell.

Embodiment 76. The method of any one of Embodiment 71 to Embodiment 73, wherein the cell is a prokaryotic cell.

Embodiment 77. A method of editing a target DNA, comprising combining the target DNA with a gene editing pair, the gene editing pair comprising a CRISPR-associated protein (Cas protein) and a guide NA variant, wherein the guide NA variant is a guide NA variant of any one of Embodiment 34 to Embodiment 60, and wherein the combining results in editing of the target DNA.

Embodiment 78. The method of Embodiment 77, wherein the Cas protein is a CasX variant of any one of Embodiment 1 to Embodiment 33, or a CasX protein of SEQ ID NO: 1, SEQ ID NO: 2, or SEQ ID NO: 3.

Embodiment 79. The method of Embodiment 77 or Embodiment 78, wherein editing occurs in vitro outside of a cell.

Embodiment 80. The method of Embodiment 77 or Embodiment 78, wherein editing occurs in vitro inside of a cell.

Embodiment 81. The method of Embodiment 77 or Embodiment 78, wherein contacting occurs in vivo inside of a cell.

Embodiment 82. The method of any one of Embodiment 79 to Embodiment 81, wherein the cell is a eukaryotic cell.

Embodiment 83. The method of Embodiment 82, wherein the eukaryotic cell is selected from the group consisting of a plant cell, a fungal cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell.

Embodiment 84. The method of any one of Embodiment 79 to Embodiment 81, wherein the cell is a prokaryotic cell.

Embodiment 85. A cell comprising a CasX variant, wherein the CasX variant is a CasX variant of any one of Embodiment 1 to Embodiment 33.

Embodiment 86. The cell of Embodiment 85, further comprising a guide NA variant of any one of Embodiment 34 to Embodiment 60, or the guide RNA of SEQ ID NO: 4 or SEQ ID NO: 5.

Embodiment 87. A cell comprising a guide NA variant, wherein the guide NA variant is a guide NA variant of any one of Embodiment 34 to Embodiment 60.

Embodiment 88. The cell of Embodiment 87, further comprising a CasX variant of any one of Embodiment 1 to Embodiment 33, or a CasX protein of SEQ ID NO: 1, SEQ ID NO: 2, or SEQ ID NO. 3.

Embodiment 89. The cell of any one of 85 to Embodiment 88, wherein the cell is a eukaryotic cell.

Embodiment 90. The cell of any one of 85 to Embodiment 88, wherein the cell is a prokaryotic cell.

Embodiment 91. A polynucleotide encoding the CasX variant of any one of Embodiment 1 to Embodiment 33.

Embodiment 92. A vector comprising the polynucleotide of Embodiment 91.

Embodiment 93. The vector of Embodiment 92, wherein the vector is a bacterial plasmid.

Embodiment 94. A cell comprising the polynucleotide of Embodiment 91, or the vector of Embodiment 92 or Embodiment 93.

Embodiment 95. A composition, comprising the CasX variant of any one of Embodiment 1 to Embodiment 33.

Embodiment 96. The composition of 95, further comprising a guide RNA variant of any one of Embodiment 34 to Embodiment 60, or the guide RNA of SEQ ID NO: 4 or SEQ ID NO: 5.

Embodiment 97. The composition of Embodiment 95 or Embodiment 96, further comprising a buffer, a nuclease inhibitor, a protease inhibitor, a liposome, a therapeutic agent, a label, a label visualization reagent, or any combination of the foregoing.

Embodiment 98. A composition, comprising a guide RNA variant of any one of Embodiment 34 to Embodiment 60.

Embodiment 99. The composition of Embodiment 98, further comprising the CasX variant of any one of 1 to Embodiment 33, or the CasX protein of SEQ ID NO: 1, SEQ ID NO: 2, or SEQ ID NO: 3.

Embodiment 100. The composition of Embodiment 98 or Embodiment 99, further comprising a buffer, a nuclease inhibitor, a protease inhibitor, a liposome, a therapeutic agent, a label, a label visualization reagent, or any combination of the foregoing.

Embodiment 101. A composition, comprising the gene editing pair of any one of Embodiment 61 to Embodiment 68.

Embodiment 102. The composition of Embodiment 101, further comprising a buffer, a nuclease inhibitor, a protease inhibitor, a liposome, a therapeutic agent, a label, a label visualization reagent, or any combination of the foregoing.

Embodiment 103. A kit, comprising the CasX variant of any one of Embodiment 1 to Embodiment 33 and a container.

Embodiment 104. The kit of Embodiment 103, further comprising a guide NA variant of any one of Embodiment 34 to Embodiment 60, or the guide RNA of SEQ ID NO: 4 or SEQ ID NO: 5.

Embodiment 105. The kit of Embodiment 103 or Embodiment 104, further comprising a buffer, a nuclease inhibitor, a protease inhibitor, a liposome, a therapeutic agent, a label, a label visualization reagent, or any combination of the foregoing.

Embodiment 106. A kit, comprising a guide NA variant of any one of Embodiment 34 to Embodiment 60.

Embodiment 107. The kit of Embodiment 106, further comprising the CasX variant of any one of Embodiment 1 to Embodiment 33, or the CasX protein of SEQ ID NO: 1, SEQ ID NO: 2, or SEQ ID NO: 3.

Embodiment 108. The kit of Embodiment 106 or Embodiment 107, further comprising a buffer, a nuclease inhibitor, a protease inhibitor, a liposome, a therapeutic agent, a label, a label visualization reagent, or any combination of the foregoing.

Embodiment 109. A kit, comprising the gene editing pair of any one of Embodiment 61 to Embodiment 68.

Embodiment 110. The kit of Embodiment 109, further comprising a buffer, a nuclease inhibitor, a protease inhibitor, a liposome, a therapeutic agent, a label, a label visualization reagent, or any combination of the foregoing.

Embodiment 111. A CasX variant comprising any one of the sequences listed in Table 3.

Embodiment 112. A guide RNA variant comprising any one of the sequences listed in Table 1 or Table 2.

Embodiment 113. The CasX variant of any one of Embodiment 1 to Embodiment 33, wherein the reference CasX protein comprises a first domain from a first CasX protein and second domain from a second CasX protein.

Embodiment 114. The CasX variant of Embodiment 113, wherein the first domain is selected from the group consisting of the NTSB, TSL, helical I, helical II, OBD, and RuvC domains.

Embodiment 115. The CasX variant of Embodiment 113, wherein the second domain is selected from the group consisting of the NTSB, TSL, helical I, helical II, OBD, and RuvC domains.

Embodiment 116. The method of any one of Embodiment 113 to Embodiment 115, wherein the first and second domains are not the same domain.

Embodiment 117. The CasX variant of any one of Embodiment 113 to Embodiment 116, wherein the first CasX protein comprises a sequence of SEQ ID NO: 1 and the second CasX protein comprises a sequence of SEQ ID NO: 2.

Embodiment 118. The CasX variant of any one of Embodiment 113 to Embodiment 116, wherein the first CasX protein comprises a sequence of SEQ ID NO: 1 and the second CasX protein comprises a sequence of SEQ ID NO: 3.

Embodiment 119. The CasX variant of any one of Embodiment 113 to Embodiment 116, wherein the first CasX protein comprises a sequence of SEQ ID NO: 2 and the second CasX protein comprises a sequence of SEQ ID NO: 3.

Embodiment 120. The CasX variant of any one of Embodiment 1 to Embodiment 33 or 113 to Embodiment 119, wherein the CasX protein comprises at least one chimeric domain comprising a first part from a first CasX protein and a second part from a second CasX protein.

Embodiment 121. The CasX variant of Embodiment 120, wherein the at least one chimeric domain is selected from the group consisting of the NTSB, TSL, helical I, helical II, OBD, and RuvC domains.

Embodiment 122. The CasX variant of Embodiment 120 or Embodiment 121, wherein the first CasX protein comprises a sequence of SEQ ID NO: 1 and the second CasX protein comprises a sequence of SEQ ID NO: 2.

Embodiment 123. The CasX variant of Embodiment 120 or Embodiment 121, wherein the first CasX protein comprises a sequence of SEQ ID NO: 1 and the second CasX protein comprises a sequence of SEQ ID NO: 3.

Embodiment 124. The CasX variant of Embodiment 120 or Embodiment 121, wherein the first CasX protein comprises a sequence of SEQ ID NO: 2 and the second CasX protein comprises a sequence of SEQ ID NO: 3.

Embodiment 125. The CasX variant of Embodiment 120, wherein the at least one chimeric comprises a chimeric RuvC domain.

Embodiment 126. The CasX variant of 125, wherein the chimeric RuvC domain comprises amino acids 661 to Embodiment 824 of SEQ ID NO: 1 and amino acids 922 to Embodiment 978 of SEQ ID NO: 2.

Embodiment 127. The CasX variant of 125, wherein the chimeric RuvC domain comprises amino acids 648 to 812 of SEQ ID NO: 2 and amino acids 935 to 986 of SEQ ID NO: 1.

Embodiment 128. The guide NA variant of any one of 34 to Embodiment 60, wherein the reference guide NA comprises a first region from a first guide NA and a second region from a second guide NA.

Embodiment 129. The guide NA variant of 128, wherein the first region is selected from the group consisting of a triplex region, a scaffold stem loop, and an extended stem loop.

Embodiment 130. The guide NA variant of 128 or 129, wherein the second region is selected from the group consisting of a triplex region, a scaffold stem loop, and an extended stem loop.

Embodiment 131. The guide NA variant of any one of Embodiments 128 to Embodiment 130, wherein the first and second regions are not the same region.

Embodiment 132. The guide NA variant of any one of Embodiments 128 to Embodiment 131, wherein the first guide NA comprises a sequence of SEQ ID NO: 4 and the second guide NA comprises a sequence of SEQ ID NO: 5.

Embodiment 133. The guide NA variant of any one of Embodiments 34-60 or Embodiments 128-132, comprising at least one chimeric region comprising a first part from a first guide NA and a second part from a second guide NA.

Embodiment 134. The guide NA variant of Embodiment 133, wherein the at least one chimeric region is selected from the group consisting of a triplex region, a scaffold stem loop, and an extended stem loop.

Embodiment 135. The guide NA variant of Embodiment 134, wherein the first guide NA comprises a sequence of SEQ ID NO: 4 and the second guide NA comprises a sequence of SEQ ID NO: 5.

Embodiment Set #2

Embodiment 1. A variant of a reference CasX protein, wherein the CasX variant is capable of forming a complex with a guide nucleic acid (gNA), and wherein the complex can bind a target nucleic acid, and wherein the CasX variant comprises at least one modification in at least one domain of the reference CasX protein selected from:

a. a non-target strand binding (NTSB) domain that binds to the non-target strand of DNA, wherein the NTSB domain comprises a four-stranded beta sheet;

b. a target strand loading (TSL) domain that places the target DNA in a cleavage site of the CasX variant, the TSL domain comprising three positively charged amino acids, wherein the three positively charged amino acids bind to the target strand of DNA, c. a helical I domain that interacts with both the target DNA and a targeting sequence of a gNA, wherein the helical I domain comprises one or more alpha helices;

d. a helical II domain that interacts with both the target DNA and a scaffold stem of the gNA;

e. an oligonucleotide binding domain (OBD) that binds a triplex region of the gNA; or f. a RuvC DNA cleavage domain;

wherein the CasX variant exhibits one or more improved characteristics as compared to the reference CasX protein.

Embodiment 2. The CasX variant of Embodiment 1, wherein the CasX reference comprises the sequence of SEQ ID NO: 1, SEQ ID NO: 2, or SEQ ID NO: 3.

Embodiment 3. The CasX variant of Embodiment 1 or Embodiment 2, wherein the at least one modification comprises at least one amino acid substitution in a domain of the CasX variant.

Embodiment 4. The CasX variant of any one of the preceding Embodiments, wherein the at least one modification comprises the substitution of 1 to 10 consecutive or non-consecutive amino acid substitutions in the CasX variant.

Embodiment 5. The CasX variant of any one of the preceding Embodiments, wherein at least one modification comprises at least one amino acid deletion in a domain of the CasX variant.

Embodiment 6. The CasX variant of any one of the preceding Embodiments, wherein the at least one modification comprises the deletion of 1 to 10 consecutive or non-consecutive amino acids in the CasX variant.

Embodiment 7. The CasX variant of any one of the preceding Embodiments, wherein the at least one modification comprises the substitution of 1 to 10 consecutive or non-consecutive amino acid substitutions and the deletion of 1 to 10 consecutive or non-consecutive amino acids in the CasX variant.

Embodiment 8. The CasX variant of any one of the preceding Embodiments, wherein the at least one modification comprises at least one amino acid insertion in a domain of the CasX variant.

Embodiment 9. The CasX variant of any one of the preceding Embodiments, wherein the at least one modification comprises the insertion of 1 to 4 consecutive or non-consecutive amino acids in a domain of the CasX variant.

Embodiment 10. The CasX variant of any one of the preceding Embodiments, wherein the CasX variant has a sequence selected from the group consisting of the sequences of Table 3, or a sequence having at least about 50%, at least about 60%, at least about 70%, at least about 80%, at least about 90%, or at least about 95%, or at least about 96%, or at least about 97%, or at least about 98%, or at least about 99%, sequence identity thereto.

Embodiment 11. The CasX variant of any one of the preceding Embodiments, wherein the CasX protein has binding affinity for a protospacer adjacent motif (PAM) sequence selected from the group consisting of TTC, ATC, GTC, and CTC.

Embodiment 12. The CasX variant of any one of the preceding Embodiments, wherein the CasX protein further comprises one or more nuclear localization signals (NLS).

Embodiment 13. The CasX variant of Embodiment 12, wherein the one or more NLS are selected from the group of sequences consisting of PKKKRKV (SEQ ID NO: 352), KRPAATKKAGQAKKKK (SEQ ID NO: 353), PAAKRVKLD (SEQ ID NO: 354), RQRRNELKRSP (SEQ ID NO: 355), NQSSNFGPMKGGNFG-GRSSGPYGGGGQYFAKPRNQGGY (SEQ ID NO: 356), RMRIZFKNKGKDTAELRRRRVEVSVELRKAKKD-EQILKRRNV (SEQ ID NO: 357), VSRKRPRP (SEQ ID NO: 358), PPKKARED (SEQ ID NO: 359), PQPKKKPL (SEQ ID NO: 360), SALIKKKKKMAP (SEQ ID NO: 361), DRLRR (SEQ ID NO: 362), PKQKKRK (SEQ ID NO: 363), RKLKKKIKKL (SEQ ID NO: 364), REKKKFLKRR (SEQ ID NO: 365), KRKGDEVDGVDEVAKKKSKK (SEQ ID NO: 366), RKCLQAGMNLEARKTKK (SEQ ID NO: 367), PRPRKIPR (SEQ ID NO: 368), PPRKKRTVV (SEQ ID NO: 369), NLSKKKKRKREK (SEQ ID NO: 370), RRPSRPFRKP (SEQ ID NO: 371), KRPRSPSS (SEQ ID NO: 372), KRGINDRNFWRGENERKTR (SEQ ID NO: 373), PRPPKMARYDN (SEQ ID NO: 374), KRSFSKAF (SEQ ID NO: 375), KLKIKRPVK (SEQ ID NO: 376), PKTRRRPRRSQRKRPPT (SEQ ID NO: 378), RRKKRR-PRRKKRR (SEQ ID NO: 381), PKKKSRKPKKKSRK (SEQ ID NO: 382), HKKKHPDASVNFSEFSK (SEQ ID NO: 383), QRPGPYDRPQRPGPYDRP (SEQ ID NO: 384), LSPSLSPLLSPSLSPL (SEQ ID NO: 385), RGKGGKGLGKGGAKRHRK (SEQ ID NO: 386), PKR-GRGRPKRGRGR (SEQ ID NO: 387), and MSRRR-KANPTKLSENAKKLAKEVEN (SEQ ID NO: 411).

Embodiment 14. The CasX variant of Embodiment 12 or Embodiment 13, wherein the one or more NLS are expressed at the C-terminus of the CasX protein.

Embodiment 15. The CasX variant of Embodiment 12 or Embodiment 13, wherein the one or more NLS are expressed at the N-terminus of the CasX protein.

Embodiment 16. The CasX variant of Embodiment 12 or Embodiment 13, wherein the one or more NLS are expressed at the N-terminus and C-terminus of the CasX protein.

Embodiment 17. The CasX variant of any one of the preceding Embodiments, wherein the improved characteristic is selected from the group consisting of improved folding of the variant, improved binding affinity to the gNA, improved binding affinity to the target DNA, altered binding affinity to one or more PAM sequences of the target DNA, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target DNA strand, improved protein stability, improved protein:gNA complex stability, improved protein solubility, improved protein:gNA complex solubility, improved protein yield, improved protein expression, and improved fusion characteristics.

Embodiment 18. The CasX variant of any one of the preceding Embodiments, wherein at least one or more of the improved characteristics of the CasX variant is at least about 1.1 to about 100,000-fold improved relative to the reference CasX protein of SEQ ID NO: 1, SEQ ID NO: 2, or SEQ ID NO: 3.

Embodiment 19. The CasX variant of any one of the preceding Embodiments, wherein one or more of the improved characteristics of the CasX variant is at least about 10 to about 100-fold improved relative to the reference CasX protein of SEQ ID NO: 1, SEQ ID NO: 2, or SEQ ID NO: 3.

Embodiment 20. The CasX variant any one of the preceding Embodiments, wherein the CasX variant has about 1.1 to about 100-fold increased binding affinity to the gNA compared to the protein of SEQ ID NO: 1, SEQ ID NO: 2, or SEQ ID NO: 3.

Embodiment 21. The CasX variant any one of the preceding Embodiments, wherein the CasX variant has about 1.1 to about 10-fold increased binding affinity to the target DNA compared to the protein of SEQ ID NO: 1, SEQ ID NO: 2, or SEQ ID NO: 3.

Embodiment 22. The CasX variant of any one of the preceding Embodiments, wherein the CasX variant comprises between 400 and 3000 amino acids.

Embodiment 23. The CasX variant of any one of the preceding Embodiments, comprising at least one modification in at least two domains of the CasX variant relative to the reference CasX protein of SEQ ID NO: 1, SEQ ID NO: 2, or SEQ ID NO: 3.

Embodiment 24. The CasX variant of any one of the preceding Embodiments, comprising two or more modifications in at least one domain of the CasX variant relative to the reference CasX protein of SEQ ID NO: 1, SEQ ID NO: 2, or SEQ ID NO: 3.

Embodiment 25. The CasX variant of any one of the preceding Embodiments, wherein at least one modification comprises deletion of at least a portion of one domain of the CasX variant relative to the reference CasX protein of SEQ ID NO: 1, SEQ ID NO: 2, or SEQ ID NO: 3.

Embodiment 26. The CasX variant of any one of the preceding Embodiments, comprising at least one modification of a region of non-contiguous amino acid residues of the CasX variant that form a channel in which gNA:target DNA complexing with the CasX variant occurs.

Embodiment 27. The CasX variant of any one of the preceding Embodiments, comprising at least one modification of a region of non-contiguous amino acid residues of the CasX variant that form an interface which binds with the gNA.

Embodiment 28. The CasX variant of any one of the preceding Embodiments, comprising at least one modification of a region of non-contiguous amino acid residues of the CasX variant that form a channel which binds with the non-target strand DNA.

Embodiment 29. The CasX variant of any one of the preceding Embodiments, comprising at least one modification of a region of non-contiguous amino acid residues of the CasX variant that form an interface which binds with the PAM.

Embodiment 30. The CasX variant of any one of the preceding Embodiments, comprising at least one modification of a region of non-contiguous surface-exposed amino acid residues of the CasX variant.

Embodiment 31. The CasX variant of any one of the preceding Embodiments, comprising at least one modification of a region of non-contiguous amino acid residues that form a core through hydrophobic packing in a domain of the CasX variant.

Embodiment 32. The CasX variant of any one of Embodiments 25-30, wherein the modification is a deletion, an insertion, and/or a substitution of one or more amino acids of the region.

Embodiment 33. The CasX variant of any one of Embodiments 25-32, wherein between 2 to 15 amino acid residues of the region of the CasX variant are substituted with charged amino acids.

Embodiment 34. The CasX variant of any one of Embodiments 25-32, wherein between 2 to 15 amino acid residues of a region of the CasX variant are substituted with polar amino acids.

Embodiment 35. The CasX variant of any one of Embodiments 25-32, wherein between 2 to 15 amino acid residues of a region of the CasX variant are substituted with amino acids that stack with DNA or RNA bases.

Embodiment 36. The CasX variant of any one of the preceding Embodiments, wherein the CasX variant protein comprises a nuclease domain having nickase activity.

Embodiment 37. The CasX variant of any one of Embodiments 1-35, wherein the CasX variant protein comprises a nuclease domain having double-stranded cleavage activity.

Embodiment 38. The CasX variant of any one of Embodiments 1-35, wherein the CasX protein is a catalytically inactive CasX (dCasX) protein, and wherein the dCasX and the gNA retain the ability to bind to the target nucleic acid.

Embodiment 39. The CasX variant of Embodiment 38, wherein the dCasX comprises a mutation at residues:
a. D672, E769, and/or D935 corresponding to the CasX protein of SEQ ID NO: 1; or
b. D659, E756 and/or D922 corresponding to the CasX protein of SEQ ID NO: 2.

Embodiment 40. The CasX variant of Embodiment 39, wherein the mutation is a substitution of alanine for the residue.

Embodiment 41. A variant of a reference guide nucleic acid (gNA) capable of binding a CasX protein, wherein the reference guide nucleic acid comprises a tracrNA sequence and a crNA sequence, wherein:
a. the tracrNA comprises a scaffold stem loop region comprising a bubble;
b. the tracrNA and the crNA form a stem and a triplex region; and
c. the tracrNA and the crNA are fused, and form a fusion stem loop region
wherein the gNA variant comprises at least one modification compared to the reference guide nucleic acid sequence, and the variant exhibits one or more improved characteristics compared to the reference guide RNA.

Embodiment 42. The gNA variant of Embodiment 41, comprising a tracrRNA stem loop comprising the sequence -UUU-N3-20-UUU- (SEQ ID NO: 4403).

Embodiment 43. The gNA variant of Embodiment 41 or 42, comprising a crRNA sequence with -AAAG- in a location 5' to a targeting sequence of the gNA variant.

Embodiment 44. The gNA variant of Embodiment 43, wherein the -AAAG-sequence is immediately 5' to the targeting sequence.

Embodiment 45. The gNA variant of any one of Embodiments 41-44, wherein the gNA variant further comprises a targeting sequence wherein the targeting sequence is complementary to the target DNA sequence.

Embodiment 46. The gNA variant of any one of Embodiments 41-45, wherein the one or more improved characteristics is selected from the group consisting of improved stability, improved solubility, improved resistance to nuclease activity, increased folding rate of the NA, decreased side product formation during folding, increased productive folding, improved binding affinity to a CasX protein, improved binding affinity to a target DNA, improved gene editing, and improved specificity.

Embodiment 47. The gNA variant of Embodiment 46, wherein the one or more of the improved characteristics of the CasX variant is at least about 1.1 to about 100,000-fold improved relative to the reference gNA of SEQ ID NO: 4 or SEQ ID NO: 5.

Embodiment 48. The CasX variant of Embodiment 46 or 47, wherein one or more of the improved characteristics of the CasX variant is at least about 10 to about 100-fold improved relative to the reference gNA of SEQ ID NO: 4 or SEQ ID NO: 5.

Embodiment 49. The gNA variant of any one of Embodiments 41-48, wherein the at least one modification comprises at least one nucleotide substitution in a region of the gNA variant compared to the reference gNA of SEQ ID NO: 4 or SEQ ID NO: 5.

Embodiment 50. The gNA variant of Embodiment 41-49, wherein the at least one modification comprises substitution of at least 1 to 4 nucleotides in a region of the gNA variant compared to the reference gNA of SEQ ID NO: 4 or SEQ ID NO: 5.

Embodiment 51. The gNA variant of any one of Embodiments 41-50, wherein the at least one modification comprises at least one nucleotide deletion in a region of the gNA variant compared to the reference gNA of SEQ ID NO: 4 or SEQ ID NO: 5.

Embodiment 52. The gNA variant of Embodiments 41-51, wherein the at least one modification comprises deletion of 1 to 4 nucleotides in a region of the gNA variant compared to the reference gNA of SEQ ID NO: 4 or SEQ ID NO: 5.

Embodiment 53. The gNA variant of any one of Embodiments 41-52, wherein the at least one modification comprises at least one nucleotide insertion in a region of the gNA variant compared to the reference gNA of SEQ ID NO: 4 or SEQ ID NO: 5.

Embodiment 54. The gNA variant of any one of Embodiments 41-53, wherein the at least one modification comprises insertion of 1 to 4 nucleotides in a region of the gNA variant compared to the reference gNA of SEQ ID NO: 4 or SEQ ID NO: 5.

Embodiment 55. The gNA variant of any one of Embodiments 41-54, wherein the at least one modification comprises a deletion of at least 1 to 4 nucleotides, an insertion of at least 1 to 4 nucleotides, a substitution of at least 1 to 4 nucleotides, or any combination thereof in a region of the gNA variant compared to the reference gNA of SEQ ID NO: 4 or SEQ ID NO: 5.

Embodiment 56. The gNA variant of any one of Embodiments 41-5, comprising a scaffold region at least 60% homologous to SEQ ID NO: 4 or SEQ ID NO: 5.

Embodiment 57. The gNA variant of any one of Embodiments 41-55, comprising a scaffold NA stem loop at least 60% homologous to SEQ ID NO: 14.

Embodiment 58. The gNA variant of any one of Embodiments 41-55, comprising an extended stem loop at least 60% homologous to SEQ ID NO: 14.

Embodiment 59. The gNA variant of any one of Embodiments 41-55, wherein the gNA variant sequence is at least 20%, at least 30%, at least 40%, at least 50%, at least 60%, or at least 70%, or at least 80% homologous to SEQ ID NO: 4.

Embodiment 60. The gNA variant of any one of Embodiments 41-58, wherein the gNA variant sequence is at least 80%, at least 90%, at least 95%, at least 96%, at least 97%, at least 98%, at least 99% homologous, or is 100% homologous to a sequence selected from the group of sequences of SEQ ID NOS: 2101-2241.

Embodiment 61. The gNA variant of any one of Embodiments 41-60, comprising an extended stem loop region comprising fewer than 10,000 nucleotides.

Embodiment 62. The gNA variant of any one of Embodiments 41-60, wherein the scaffold stem loop or the extended stem loop sequence is replaced with an exogenous stem loop sequence.

Embodiment 63. The gNA variant of Embodiment t 62, wherein the exogenous stem loop is a hairpin loop that is capable of binding a protein, RNA or DNA molecule.

Embodiment 64. The gNA variant of Embodiment 62 or 63, wherein the exogenous stem loop is a hairpin loop that increases the stability of the gNA.

Embodiment 65. The gNA variant of Embodiment 63 or 64, wherein the hairpin loop is selected from MS2, Qβ, U1A, or PP7.

Embodiment 66. The gNA variant of any one of Embodiments 41-65, further comprising one or more ribozymes.

Embodiment 67. The gNA variant of Embodiment 66, wherein the one or more ribozymes are independently fused to a terminus of the gNA variant.

Embodiment 68. The gNA variant of Embodiment 66 or 67, wherein at least one of the one or more ribozymes are an hepatitis delta virus (HDV) ribozyme, hammerhead ribozyme, pistol ribozyme, hatchet ribozyme, or tobacco ringspot virus (TRSV) ribozyme.

Embodiment 69. The gNA variant of any one of Embodiments 41-68, further comprising a protein binding motif.

Embodiment 70. The gNA variant of any one of Embodiments 41-69, further comprising a thermostable stem loop.

Embodiment 71. The gNA variant of Embodiment 41, comprising the sequence of any one of SEQ ID NO: 2101-2241.

Embodiment 72. The gNA variant of any one of Embodiments 41-71, further comprising a targeting sequence.

Embodiment 73. The gNA variant of Embodiment 72, wherein the targeting sequence has 14, 15, 16, 18, 18, 19, 20, 21, 22, 23 24, 25, 26, 27, 28, 29, 30, 31, 32, 33, 34 or 35 nucleotides.

Embodiment 74. The gNA variant of any one of Embodiments 41-73, wherein the gNA is chemically modified.

Embodiment 75. A gene editing pair comprising a CasX protein and a first gNA.

Embodiment 76. The gene editing pair of Embodiment 74, wherein the first gNA comprises:
 a. a gNA variant of any one of Embodiments 41-74 and a targeting sequence; or
 b. a reference guide nucleic acid of SEQ ID NOS: 4 or 5 and a targeting sequence,
wherein the targeting sequence is complementary to the target nucleic acid.

Embodiment 77. The gene editing pair of Embodiment 74 or 76, wherein the CasX comprises:
 a. a CasX variant of any one of Embodiments 1-40; or
 b. a reference CasX protein of SEQ ID NO: 1, SEQ ID NO: 2, or SEQ ID NO: 3.

Embodiment 78. The gene editing pair of any one of Embodiments 74-77, further comprising a second gNA or a nucleic acid encoding the second gNA, wherein the second gNA has a targeting sequence complementary to a different portion of the target nucleic acid compared to the targeting sequence of the first gNA.

Embodiment 79. The gene editing pair of any one of Embodiments 74-78, wherein the CasX protein and the gNA are capable of associating together in a ribonuclear protein complex (RNP).

Embodiment 80. The gene editing pair of any one of Embodiments 74-79, wherein the CasX protein and the gNA are associated together in a ribonuclear protein complex (RNP).

Embodiment 81. The gene editing pair of Embodiment 79 or 80, wherein the RNP is capable of binding a target DNA.

Embodiment 82. The gene editing pair of any one of Embodiments 79-81, wherein the RNP has a higher percentage of cleavage-competent RNP compared to an RNP of a reference CasX protein and a reference guide nucleic acid.

Embodiment 83. The gene editing pair of any one of Embodiments 79-82, wherein the RNP is capable of binding and cleaving a target DNA.

Embodiment 84. The gene editing pair of any one of Embodiments 79-82, wherein the RNP binds a target DNA but does not cleave the target DNA.

Embodiment 85. The gene editing pair of any one of Embodiments 79-83, wherein the RNP is capable of binding a target DNA and generating one or more single-stranded nicks in the target DNA.

Embodiment 86. The gene editing pair of any one of Embodiments 79-83 or 85, wherein the gene editing pair has one or more improved characteristics compared to a gene editing pair comprising a reference CasX protein of SEQ ID NO: 1, SEQ ID NO: 2, or SEQ ID NO: 3 and a reference guide nucleic acid of SEQ ID NOS: 4 or 5.

Embodiment 87. The gene editing pair of Embodiment 86, wherein the one or more improved characteristics comprises improved CasX:gNA RNP complex stability, improved binding affinity between the CasX and gNA, improved kinetics of RNP complex formation, higher percentage of cleavage-competent RNP, improved RNP binding affinity to the target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, or improved resistance to nuclease activity.

Embodiment 88. The gene editing pair of Embodiment 86 or 87, wherein the at least one or more of the improved characteristics is at least about 1.1 to about 100,000-fold improved relative to a gene editing pair of the reference CasX protein and the reference guide nucleic acid.

Embodiment 89. The gene editing pair of any one of Embodiments 86-88, wherein one or more of the improved characteristics of the CasX variant is at least about 10 to about 100-fold improved relative to a gene editing pair of the reference CasX protein and the reference guide nucleic acid.

Embodiment 90. A method of editing a target DNA, comprising contacting the target DNA with a gene editing pair of any one of Embodiments 74-89, wherein the contacting results in editing of the target DNA.

Embodiment 91. The method of Embodiment 90, comprising contacting the target DNA with a plurality of gNAs comprising targeting sequences complementary to different regions of the target DNA.

Embodiment 92. The method of Embodiment 90 or 91, wherein the contacting introduces one or more single-stranded breaks in the target DNA and wherein the editing comprises a mutation, an insertion, or a deletion in the target DNA.

Embodiment 93. The method of Embodiment 90 or 91, wherein the contacting comprises introducing one or more double-stranded breaks in the target DNA and wherein the editing comprises a mutation, an insertion, or a deletion in the target DNA.

Embodiment 94. The method of any one of Embodiments 90-93, further comprising contacting the target DNA with a nucleotide sequence of a donor template nucleic acid wherein the donor template comprises a nucleotide sequence having homology to the target DNA.

Embodiment 95. The method of Embodiment 94, wherein the donor template is inserted in the target DNA at the break site by homology-directed repair.

Embodiment 96. The method of any one of Embodiments 90-95, wherein editing occurs in vitro outside of a cell.

Embodiment 97. The method of any one of Embodiments 90-95, wherein editing occurs in vitro inside of a cell.

Embodiment 98. The method of any one of Embodiments 90-95, wherein editing occurs in vivo inside of a cell.

Embodiment 99. The method of Embodiments 97 or 98, wherein the cell is a eukaryotic cell.

Embodiment 100. The method of Embodiment 99, wherein the eukaryotic cell is selected from the group consisting of a plant cell, a fungal cell, a protist cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell.

Embodiment 101. The method of Embodiment 99 or 100, wherein the method comprises contacting the eukaryotic cell with a vector encoding or comprising the CasX protein and the gNA, and optionally further comprising the donor template.

Embodiment 102. The method of Embodiment 101, wherein the vector is an Adeno-Associated Viral (AAV) vector.

Embodiment 103. The method of Embodiment 102, wherein the AAV is AAV1, AAV2, AAV3, AAV4, AAV5, AAV6, AAV7, AAV8, AAV9, AAV10, AAV-Rh74, or AAVRh10.

Embodiment 104. The method of Embodiment 101, wherein the vector is a lentiviral vector.

Embodiment 105. The method of Embodiment 101, wherein the vector is a virus-like particle (VLP).

Embodiment 106. The method of any one of Embodiments 101-105, wherein the vector is administered to a subject at a therapeutically effective dose.

Embodiment 107. The method of Embodiment 105, wherein the subject is selected from the group consisting of mouse, rat, pig, non-human primate, and human.

Embodiment 108. The method of Embodiment 107, wherein the subject is a human.

Embodiment 109. The method of any one of Embodiments 106-108, wherein the vector is administered at a dose of at least about $1 \times 10^{10}$ vector genomes (vg), or at least about $1 \times 10^{11}$ vg, or at least about $1 \times 10^{12}$ vg, or at least about $1 \times 10^{13}$ vg, or at least about $1 \times 10^{14}$ vg, or at least about $1 \times 10^{15}$ vg, or at least about $1 \times 10^{16}$ vg.

Embodiment 110. The method of any one of Embodiments 106-109, wherein the vector is administered by a route of administration selected from the group consisting of intraparenchymal, intravenous, intra-arterial, intracerebroventricular, intracisternal, intrathecal, intracranial, and intraperitoneal routes.

Embodiment 111. The method of Embodiment 97, wherein the cell is a prokaryotic cell.

Embodiment 112. A cell comprising a CasX variant, wherein the CasX variant is a CasX variant of any one of Embodiments 1-40.

Embodiment 113. The cell of Embodiment 112, further comprising
 a. a gNA variant of any one of Embodiments 41-74, or
 b. a reference guide nucleic acid of SEQ ID NOS: 4 or 5 and a targeting sequence.

Embodiment 114. A cell comprising a gNA variant of any one of Embodiments 41-74.

Embodiment 115. The cell of Embodiment 114, further comprising a CasX variant of any one of Embodiments 1 to Embodiment 35, or a CasX protein of SEQ ID NO: 1, SEQ ID NO: 2, or SEQ ID NO: 3.

Embodiment 116. The cell of Embodiment 114 or 115, further comprising a donor nucleotide template comprising a sequence that hybridizes with a target DNA.

Embodiment 117. The cell of Embodiment 116, wherein the donor template ranges in size from 10-10,000 nucleotides.

Embodiment 118. The cell of Embodiment 116 or 117, wherein the donor template is a single-stranded DNA template or a single stranded RNA template.

Embodiment 119. The method of Embodiment 116 or 117, wherein the donor template is a double-stranded DNA template.

Embodiment 120. The cell of any one of Embodiments 112-119, wherein the cell is a eukaryotic cell.

Embodiment 121. The cell of any one of Embodiments 112-119, wherein the cell is a prokaryotic cell.

Embodiment 122. A polynucleotide encoding the CasX variant of any one of Embodiments 1 to 40.

Embodiment 123. A polynucleotide encoding the gNA variant of any one of Embodiments 41-74.

Embodiment 124. A vector comprising the polynucleotide of Embodiment 122 and/or

Embodiment 125. The vector of Embodiment 123, wherein the vector is an Adeno-Associated Viral (AAV) vector.

Embodiment 126. The method of Embodiment 125, wherein the AAV is AAV1, AAV2, AAV3, AAV4, AAV5, AAV6, AAV7, AAV8, AAV9, AAV10, AAV-Rh74, or AAVRh10.

Embodiment 127. The vector of Embodiment 123, wherein the vector is a lentiviral vector.

Embodiment 128. The vector of Embodiment 124, wherein the vector is a virus-like particle (VLP).

Embodiment 129. A cell comprising the polynucleotide of Embodiment 122, or the vector of any one of Embodiments 124-128.

Embodiment 130. A composition, comprising the CasX variant of any one of Embodiments 1 to 35.

Embodiment 131. The composition of Embodiment 130, further comprising:
 a. a gNA variant of any one of Embodiments 45-74, or
 b. the reference guide RNA of SEQ ID NOS: 4 or 5 and a targeting sequence.

Embodiment 132. The composition of Embodiment 130 or 131, wherein the CasX protein and the gNA are associated together in a ribonuclear protein complex (RNP).

Embodiment 133. The composition of any one of Embodiments 130-132, further comprising a donor template nucleic acid wherein the donor template comprises a nucleotide sequence having homology to a target DNA.

Embodiment 134. The composition of any one of Embodiments 130-133, further comprising a buffer, a nuclease inhibitor, a protease inhibitor, a liposome, a therapeutic agent, a label, a label visualization reagent, or any combination of the foregoing.

Embodiment 135. A composition, comprising a gNA variant of any one of Embodiments 41-74.

Embodiment 136. The composition of Embodiment 135, further comprising the CasX variant of any one of Embodiments 1 to 35, or the CasX protein of SEQ ID NO: 1, SEQ ID NO: 2, or SEQ ID NO: 3.

Embodiment 137. The composition of Embodiment 136, wherein the CasX protein and the gNA are associated together in a ribonuclear protein complex (RNP).

Embodiment 138. The composition of any one of Embodiments 135-137, further comprising a donor template nucleic acid wherein the donor template comprises a nucleotide sequence having homology to a target DNA.

Embodiment 139. The composition of any one of Embodiments 135-138, further comprising a buffer, a nuclease inhibitor, a protease inhibitor, a liposome, a therapeutic agent, a label, a label visualization reagent, or any combination of the foregoing.

Embodiment 140. A composition, comprising the gene editing pair of any one of Embodiments 4-89.

Embodiment 141. The composition of Embodiment 140, further comprising a donor template nucleic acid wherein the donor template comprises a nucleotide sequence having homology to a target DNA.

Embodiment 142. The composition of Embodiment 140 or 141, further comprising a buffer, a nuclease inhibitor, a protease inhibitor, a liposome, a therapeutic agent, a label, a label visualization reagent, or any combination of the foregoing.

Embodiment 143. A kit, comprising the CasX variant of any one of Embodiments 1 to 35 and a container.

Embodiment 144. The kit of Embodiment 143, further comprising:
 a. a gNA variant of any one of Embodiments 45-74, or
 b. the reference guide RNA of SEQ ID NOS: 4 or 5 and a targeting sequence.

Embodiment 145. The kit of Embodiment 143 or 144, further comprising a donor template nucleic acid wherein the donor template comprises a nucleotide sequence having homology to a target sequence of a target DNA.

Embodiment 146. The kit of any one of Embodiments 143-145, further comprising a buffer, a nuclease inhibitor, a protease inhibitor, a liposome, a therapeutic agent, a label, a label visualization reagent, or any combination of the foregoing.

Embodiment 147. A kit, comprising a gNA variant of any one of Embodiments 45-74.

Embodiment 148. The kit of Embodiment 147, further comprising the CasX variant of any one of Embodiments 1 to 35, or the CasX protein of SEQ ID NO: 1, SEQ ID NO: 2, or SEQ ID NO: 3.

Embodiment 149. The kit of Embodiment 147 or 148, further comprising a donor template nucleic acid wherein the donor template comprises a nucleotide sequence having homology to a target sequence of a target DNA.

Embodiment 150. The kit of any one of Embodiments 147-149, further comprising a buffer, a nuclease inhibitor, a protease inhibitor, a liposome, a therapeutic agent, a label, a label visualization reagent, or any combination of the foregoing.

Embodiment 151. A kit, comprising the gene editing pair of any one of Embodiments 74-89.

Embodiment 152. The kit of Embodiment 151, further comprising a donor template nucleic acid wherein the donor template comprises a nucleotide sequence having homology to a target DNA.

Embodiment 153. The kit of Embodiment 151 or 152, further comprising a buffer, a nuclease inhibitor, a protease inhibitor, a liposome, a therapeutic agent, a label, a label visualization reagent, or any combination of the foregoing.

Embodiment 154. A CasX variant comprising any one of the sequences listed in Table 3.

Embodiment 155. A gNA variant comprising any one of the sequences listed in Table 2.

Embodiment 156. The gNA variant of Embodiment 155, further comprising a targeting sequence of at least 10 to 30 nucleotides complementary to a target DNA.

Embodiment 157. The gNA variant of Embodiment 156, wherein the targeting sequence has 20 nucleotides.

Embodiment 158. The gNA variant of Embodiment 156, wherein the targeting sequence has 19 nucleotides.

Embodiment 159. The gNA variant of Embodiment 156, wherein the targeting sequence has 18 nucleotides Embodiment 160. The gNA variant of Embodiment 156, wherein the targeting sequence has 17 nucleotides Embodiment 161. The CasX variant of any one of Embodiments 1 to 40, wherein the CasX protein comprises a first domain from a first CasX protein and second domain from a second CasX protein different from the first CasX protein.

Embodiment 162. The CasX variant of Embodiment 161, wherein the first domain is selected from the group consisting of the NTSB, TSL, helical I, helical II, OBD, and RuvC domains.

Embodiment 163. The CasX variant of Embodiment 162, wherein the second domain is selected from the group consisting of the NTSB, TSL, helical I, helical II, OBD, and RuvC domains.

Embodiment 164. The CasX variant of any one of Embodiments 161 163, wherein the first and second domains are not the same domain.

Embodiment 165. The CasX variant of any one of Embodiments 161-164 wherein the first CasX protein comprises a sequence of SEQ ID NO: 1 and the second CasX protein comprises a sequence of SEQ ID NO: 2.

Embodiment 166. The CasX variant of any one of Embodiments 161-164 wherein the first CasX protein comprises a sequence of SEQ ID NO: 1 and the second CasX protein comprises a sequence of SEQ ID NO: 3.

Embodiment 167. The CasX variant of any one of Embodiments 161-164, wherein the first CasX protein comprises a sequence of SEQ ID NO: 2 and the second CasX protein comprises a sequence of SEQ ID NO: 3.

Embodiment 168. The CasX variant of any one of Embodiments 1 to 40 or 161-167, wherein the CasX protein comprises at least one chimeric domain comprising a first part from a first CasX protein and a second part from a second CasX protein different from the first CasX protein.

Embodiment 169. The CasX variant of Embodiment 168, wherein the at least one chimeric domain is selected from the group consisting of the NTSB, TSL, helical I, helical II, OBD, and RuvC domains.

Embodiment 170. The CasX variant of Embodiment 168 or 169, wherein the first CasX protein comprises a sequence of SEQ ID NO: 1 and the second CasX protein comprises a sequence of SEQ ID NO: 2.

Embodiment 171. The CasX variant of Embodiment 168 or 169, wherein the first CasX protein comprises a sequence of SEQ ID NO: 1 and the second CasX protein comprises a sequence of SEQ ID NO: 3.

Embodiment 172. The CasX variant of Embodiment 168 or 169, wherein the first CasX protein comprises a sequence of SEQ ID NO: 2 and the second CasX protein comprises a sequence of SEQ ID NO: 3.

Embodiment 173. The CasX variant of Embodiment 168, wherein the at least one chimeric domain comprises a chimeric RuvC domain.

Embodiment 174. The CasX variant of Embodiment 173, wherein the chimeric RuvC domain comprises amino acids 661 to 824 of SEQ ID NO: 1 and amino acids 922 to 978 of SEQ ID NO: 2.

Embodiment 175. The CasX variant of Embodiment 173, wherein the chimeric RuvC domain comprises amino acids 648 to 812 of SEQ ID NO: 2 and amino acids 935 to 986 of SEQ ID NO: 1.

Embodiment 176. The gNA variant of any one of Embodiments 41-74, wherein the gNA comprises a first region from a first gNA and a second region from a second gNA.

Embodiment 177. The gNA variant of Embodiment 176, wherein the first region is selected from the group consisting of a triplex region, a scaffold stem loop, and an extended stem loop.

Embodiment 178. The gNA variant of Embodiment 176 or 177, wherein the second region is selected from the group consisting of a triplex region, a scaffold stem loop, and an extended stem loop.

Embodiment 179. The gNA variant of any one of Embodiments 176-178, wherein the first and second regions are not the same region.

Embodiment 180. The gNA variant of any one of Embodiments 176-179, wherein the first gNA comprises a sequence of SEQ ID NO: 4 and the second gNA comprises a sequence of SEQ ID NO: 5.

Embodiment 181. The gNA variant of any one of Embodiments 41-74 or 176-180, comprising at least one chimeric region comprising a first part from a first gNA and a second part from a second gNA.

Embodiment 182. The gNA variant of Embodiment 181, wherein the at least one chimeric region is selected from the group consisting of a triplex region, a scaffold stem loop, and an extended stem loop.

Embodiment 183. The gNA variant of Embodiment 182, wherein the first gNA comprises a sequence of SEQ ID NO: 4 and the second gNA comprises a sequence of SEQ ID NO: 5.

The following Examples are merely illustrative and are not meant to limit any aspects of the present disclosure in any way.

EXAMPLES

Example 1: Assays Used to Measure sgRNA and CasX Protein Activity

Several assays were used to carry out initial screens of CasX protein and sgRNA DME libraries and engineered mutants, and to measure the activity of select protein and sgRNA variants relative to CasX reference sgRNAs and proteins.

Figure 13C:
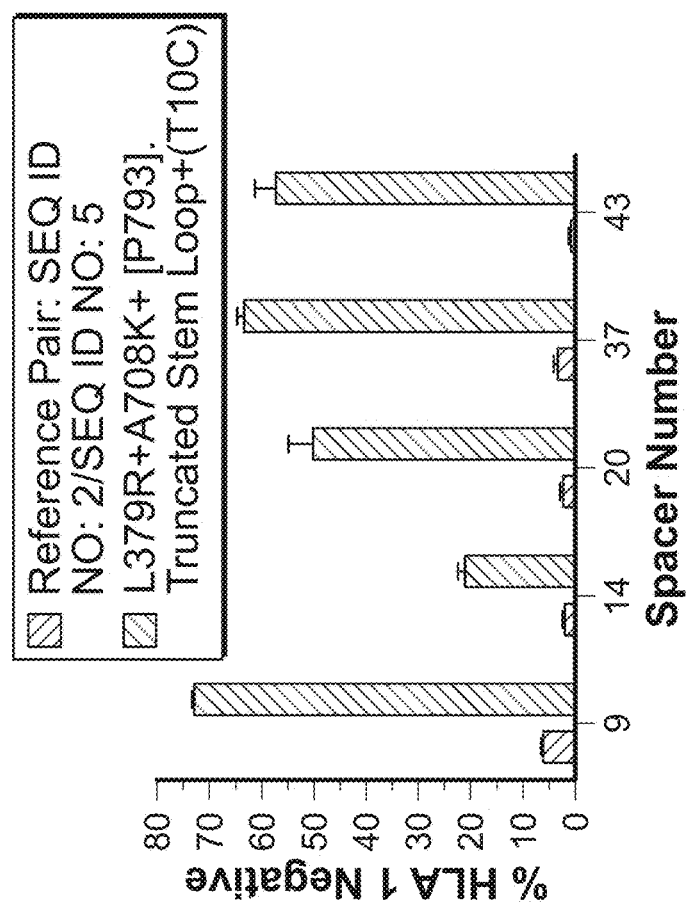
FIG. 13A, FIG. 13B and FIG. 13C show that making and screening DME libraries has allowed for generation and identification of variants that exhibit a 1 to 81-fold improvement in editing efficiency, as described in Examples 1 and 3.
Figure 13B:
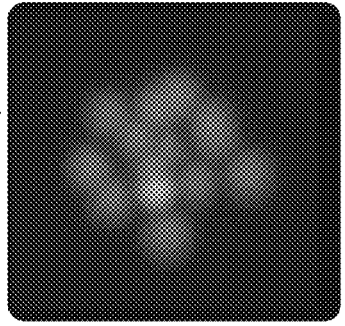
Figure 13A:
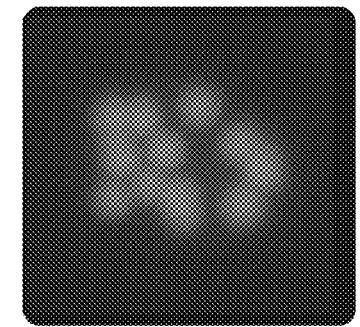
Figure 14A:
FIGS. 14A-14F are a series of structural models of a prototypic CasX protein showing the location of mutations in CasX variant proteins of the disclosure which exhibit improved activity.
Figure 14B:
Figure 14C:
Figure 14D:
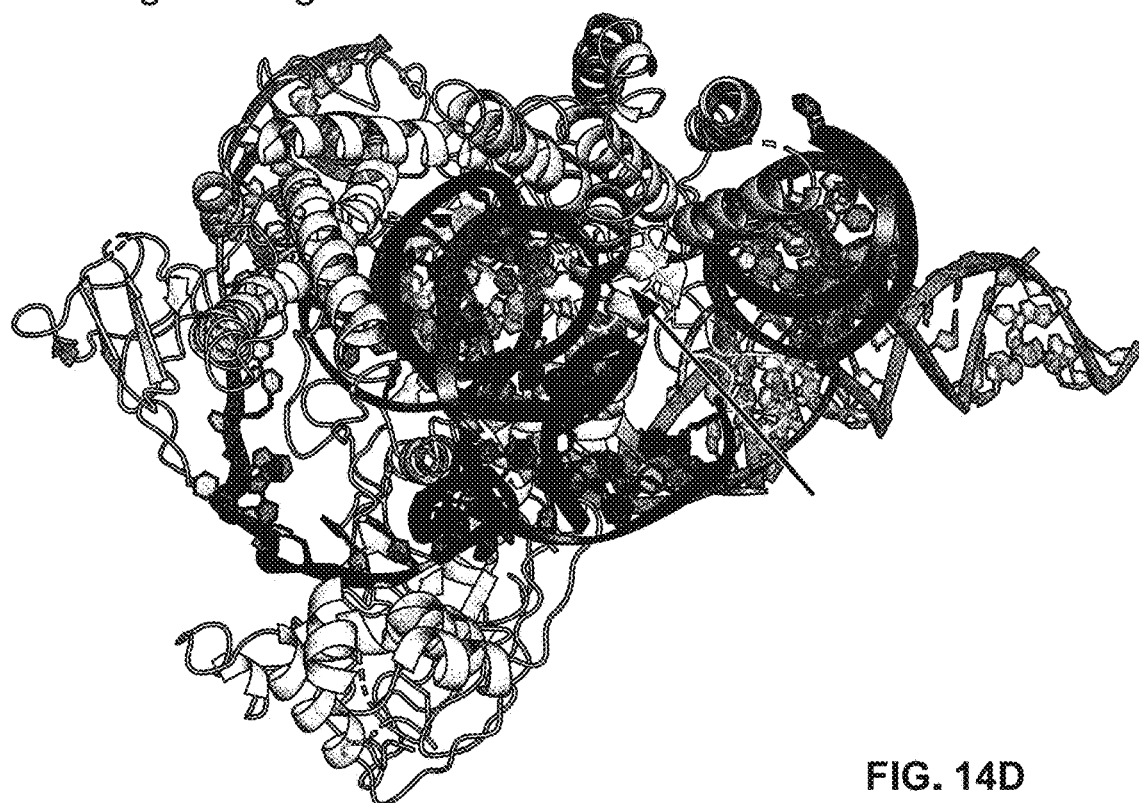
Figure 14E:
Figure 14F:
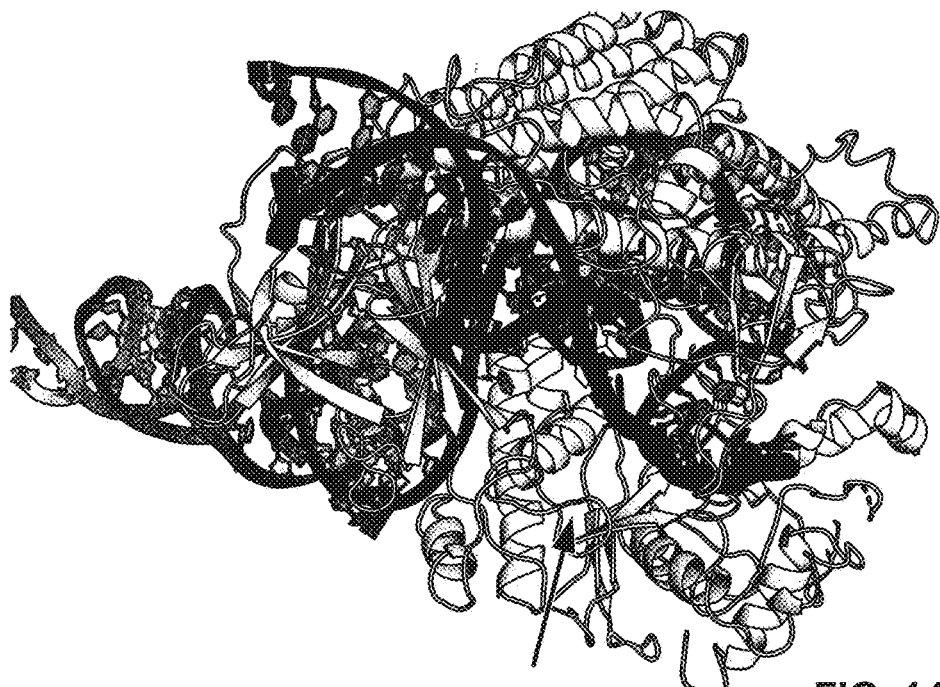

E. coli CRISPRi Screen:

Briefly, biological triplicates of dead CasX DME Libraries on a chloramphenicol (CM) resistant plasmid with a GFP guide RNA on a carbenicillin (Carb) resistant plasmid were transformed (at >5× library size) into MG1655 with genetically integrated and constitutively expressed GFP and RFP (see FIG. 13A-13B). Cells were grown overnight in EZ-RDM+Carb, CM and Anhydrotetracycline (aTc) inducer. E. coli were FACS sorted based on gates for the top 1% of GFP but not RFP repression, collected, and resorted immediately to further enrich for highly functional CasX molecules. Double sorted libraries were then grown out and DNA was collected for deep sequencing on a highseq. This DNA was also re-transformed onto plates and individual clones were picked for further analysis. E. coli Toxin selection:

Briefly carbenicillin resistant plasmid containing an arabinose inducible toxin were transformed into E. coli cells and made electrocompetent. Biological triplicates of CasX DME Libraries with a toxin targeted guide RNA on a chloramphenicol resistant plasmid were transformed (at >5× library size) into said cells and grown in LB+CM and arabinose inducer. E. coli that cleaved the toxin plasmid survived in the induction media and were grown to mid log and plasmids with functional CasX cleavers were recovered. This selection was repeated as needed. Selected libraries were then grown out and DNA was collected for deep sequencing on a highseq. This DNA was also re-transformed onto plates and individual clones were picked for further analysis and testing.

Lentiviral Based Screen EGFP Screen:

Lentiviral particles were produced in HEK293 cells at a confluency of 70%-90% at time of transfection. Cells were transfected using polyethylenimine based transfection of plasmids containing a CasX DME library. Lentiviral vectors were co-transfected with the lentiviral packaging plasmid and the VSV-G envelope plasmids for particle production. Media was changed 12 hours post-transfection, and virus harvested at 36-48 hours post-transfection. Viral supernatants were filtered using 0.45 mm membrane filters, diluted in cell culture media if appropriate, and added to target cells HEK cells with an Integrated GFP reporter. Polybrene was supplemented to enhance transduction efficiency, if necessary. Transduced cells were selected for 24-48 hours post-transduction using puromycin and grown for 7-10 days. Cells were then sorted for GFP disruption & collected for highly functional sgRNA or protein variants (see FIG. 2). Libraries were then Amplified via PCR directly from the genome and collected for deep sequencing on a highseq. This DNA could also be re-cloned and re-transformed onto plates and individual clones were picked for further analysis.

Assaying Editing Efficiency of an HEK EGFP Reporter:

To assay the editing efficiency of CasX reference sgRNAs and proteins and variants thereof, EGFP HEK293T reporter cells were seeded into 96-well plates and transfected according to the manufacturer's protocol with Lipofectamine™ 3000 (Life Technologies) and 100-200 ng plasmid DNA encoding a reference or variant CasX protein, P2A-puromycin fusion and the reference or variant sgRNA. The next day cells were selected with 1.5 µg/ml puromycin for 2 days and analyzed by fluorescence-activated cell sorting (FACS) 7 days after selection to allow for clearance of EGFP protein from the cells. EGFP disruption via editing was traced using an Attune NxT Flow Cytometer and high-throughput autosampler.

Example 2: Cleavage Efficiency of CasX Reference sgRNA

The reference CasX sgRNA of SEQ ID NO: 4 (below) is described in WO 2018/064371, the contents of which are incorporated herein by reference.

When testing cleavage of an EGFP reporter by CasX reference and sgRNA variants, the following DNA encoding spacer target sequences were used:

```
E6
    (TGTGGTCGGGGTAGCGGCTG; SEQ ID NO: 29) and

E7
    (TCAAGTCCGCCATGCCCGAA; SEQ ID NO: 30).
```

Figure 5A:
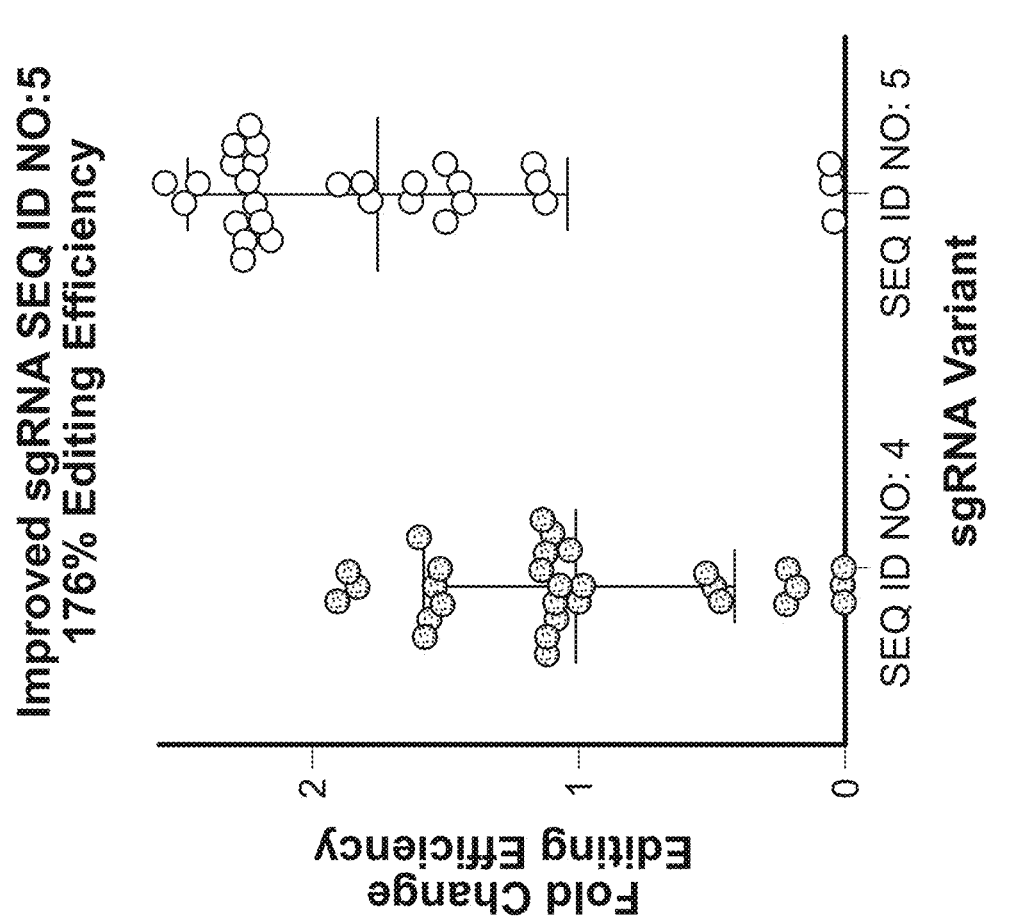
FIGS. 5A-5E are a series of plots showing that sgNA variants can improve gene editing by greater than two fold in an EGFP disruption assay, as described in Examples 2 and 3. Editing was measured by indel formation and GFP disruption in HEK293 cells carrying a GFP reporter.
Figure 5B:
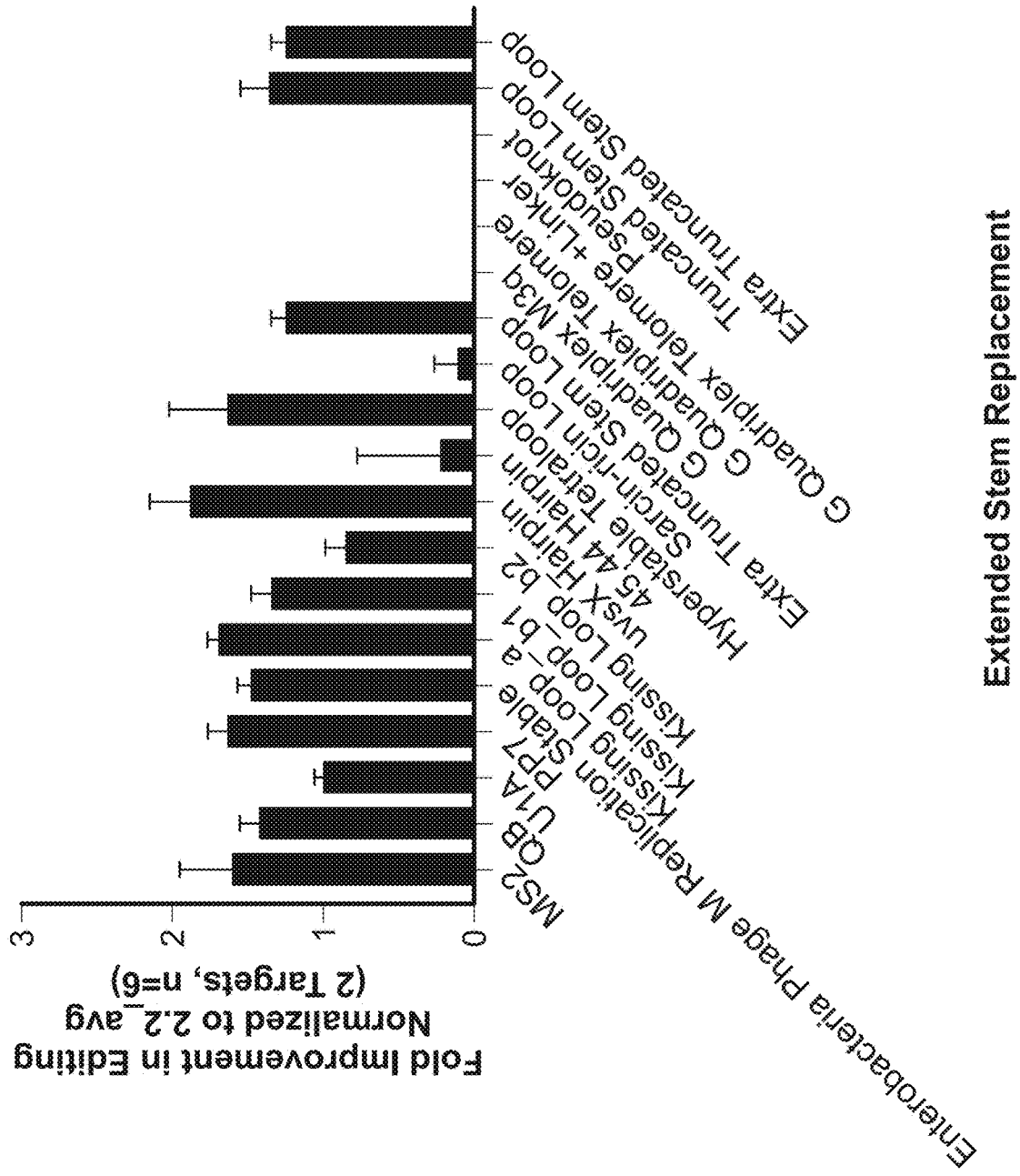

An example of the increased cleavage efficiency of the sgRNA of SEQ ID NO: 5 compared to the sgRNA of SEQ ID NO: 4 is shown in FIG. 5A. Editing efficiency of SEQ ID NO: 5 was improved 176% compared to SEQ ID NO: 4. Accordingly, SEQ ID NO: 5 was chosen as reference sgRNA for DME and additional sgRNA variant design, described below.

Example 3: Mutagenesis of CasX Reference gRNA Produces Variants with Improved Target Cleavage DME of the sgRNA was achieved using two distinct PCR methods. The first method, which generates single nucleotide substitutions, makes use of degenerate oligonucleotides. These are synthesized with a custom nucleotide mix, such that each locus of the primer that is complementary to the sgRNA locus has a 97% chance of being the wild type base, and a 1% chance of being each of the other three nucleotides. During PCR, the degenerate oligos anneal to, and just beyond, the sgRNA scaffold within a small plasmid, amplifying the entire plasmid. The PCR product was purified, ligated, and transformed into E. coli. The second method was used to generate sgRNA scaffolds with single or double nucleotide insertions and deletions. A unique PCR reaction was set up for each base pair intended for mutation: In the case of the CasX scaffold of SEQ ID NO: 5, 109 PCRs were used. These PCR primers were designed and paired such that PCR products either were missing a base pair, or contained

```
                                                     (SEQ ID NO: 4)
 1 ACAUCUGGCG CGUUUAUUCC AUUACUUUGG AGCCAGUCCC AGCGACUAUG UCGUAUGGAC

61 GAAGCGCUUA UUIAUCGGAG AGAAACCGAU AAGUAAAACG CAUCAAAG.
```

It was found that alterations to the sgRNA reference sequence of SEQ ID NO: 4, producing SEQ ID NO: 5 (below) were able to improve CasX cleavage efficiency.

an additional inserted base pair. For inserted base pairs, PCR primers inserted a degenerate base such that all four possible nucleotides were represented in the final library.

```
                                                     (SEQ ID NO: 5)
 1 UACUGGCGCU UUUAUCUCAU UACUUUGAGA GCCAUCACCA GCGACUAUGU CGUAUGGGUA

61 AAGCGCUUAU UUAUCGGAGA GAAAUCCGAU AAAUAAGAAG CAUCAAAG.
```

To assay the editing efficiency of CasX reference sgRNAs and variants thereof, EGFP HEK293T reporter cells were seeded into 96-well plates and transfected according to the manufacturer's protocol with Lipofectamine™ 3000 (Life Technologies) and 100-200 ng plasmid DNA encoding a reference CasX protein, P2A-puromycin fusion and the sgRNA. The next day cells were selected with 1.5 µg/ml puromycin for 2 days and analyzed by fluorescence-activated cell sorting (FACS) 7 days after selection to allow for clearance of EGFP protein from the cells. EGFP disruption via editing was traced using an Attune NxT Flow Cytometer and high-throughput autosampler.

Once constructed, both the protein and sgRNA DME libraries were assayed in a screen or selection as described in Example 1 to quantitatively identify mutations conferring enhanced functionality. Any assay, such as cell survival or fluorescence intensity, is sufficient so long as the assay maintains a link between genotype and phenotype. High throughput sequencing of these populations and validating individual variant phenotypes provided information about mutations that affect functionality as assayed by screening or selection. Statistical analysis of deep sequencing data provided detailed insight into the mutation landscape and mechanism of protein function or guide RNA function (see FIG. 3A-3B, FIG. 4A, FIG. 4B, FIG. 4C).

DME libraries sgRNA RNA variants were made using a reference gRNA of SEQ ID NO: 5, underwent selection or enrichment, and were sequenced to determine the fold enrichment of the sgRNA variants in the library. The libraries included every possible single mutation of every nucleotide, and double indels (insertion/deletions). The results are shown in FIGS. 3A-3B, FIGS. 4A-4C, and Table 4 below.

To create a library of base pair substitutions using DME, two degenerate oligonucleotides that each bind to half of the sgRNA scaffold and together amplify the entire plasmid comprising the starting sgRNA scaffold were designed. These oligos were made from a custom nucleotide mix with a 3% mutation rate. These degenerate oligos were then used to PCR amplify the starting scaffold plasmid using standard manufacturing protocols. This PCR product was gel purified, again following standard protocols. The gel purified PCR product was then blunt end ligated and electroporated into an appropriate E. coli cloning strain. Transformants were grown overnight on standard media, and plasmid DNA was purified via miniprep.

To generate a library of small insertions and deletions, PCR primers were designed such that the PCR products resulting from amplification of the plasmid comprising the base sgRNA scaffold would either be missing a base pair, or contain an additional inserted base pair. For inserted base pairs, PCR primers were designed in which a degenerate base has been inserted, such that all four possible nucleotides were represented in the final library of pooled PCR products. The starting sgRNA scaffold was then PCR amplified with each set of oligos as their own reaction. Each PCR reaction contained five possible primers, although all primers annealed to the same sequence. For example, Primer 1 omitted a base, in order to create a deletion. Primers 2, 3, 4, and 5 inserted either an A, T, G, or C. However, these five primers all annealed to the same region and hence could be pooled in a single PCR. However, PCRs for different positions along the sgRNA needed to be kept in separate tubes, and 109 distinct PCR reactions were used to generate the sgRNA DME library.

The resulting 109 PCR products were then run on an agarose gel and excised before being combined and purified. The pooled PCR products were blunt ligated and electroporated into E. coli. Transformants were grown overnight on standard media with an appropriate selectable marker, and plasmid DNA was purified via miniprep. Having created a library of all single small indels, the steps of PCR amplifying the starting plasmid with each set of oligos, purifying, blunt end ligating, transforming into E. coli and miniprepping can be repeated to obtain a library containing most double small indels. Combining the single indel library and double indel library at a ratio of 1:1000 resulted in a library that represented both single and double indels.

The resulting libraries were then combined and passed through the DME screening and/or selection process to identify variants with enhanced cleavage activity. DME libraries were screened using toxin cleavage and CRISPRi repression in E. coli, as well as EGFP cutting in lentiviral-transfected HEK293 cells, as described in Example 1. The fold enrichment of scaffold variants in DME libraries that have undergoing screening/selection followed by sequencing is shown below in Table 4. The read counts associated with each of the below sequences in Table 4 were determined ('annotations', 'seq'). Only sequences with at least 10 reads across any sample were analyzed to filter from 15 Million to 600 K sequences. The below 'seq' gives the sequence of the entire insert between the two 5' random 5mer and the 3' random 5mer. 'seq_short' gives the anticipated sequence of the scaffold only. The mutations associated with each sequence were determined through alignment ('muts'). All modifications are indicated by their [position (0-indexed)].[reference base].[alternate base]. Position 0 indicates the first T of the transcribed gRNA. Sequences with multiple mutations are semicolon separated. The column muts_lindexed, gives the same information but 1-indexed instead of 0-indexed. Each of the modifications are annotated ('annotated_variants'), as being a single substitution/insertion/deletion, double substitution/insertion/deletion, single_del_single_sub (a deletion and an adjacent substitution), a single_sub_single_ins (a substitution and adjacent insertion), 'outside_ref' (indicates that the modification is outside the transcribed gRNA), or 'other' (any larger substitution/insertion/deletion or some combination thereof). An insertion at position i indicates an inserted base between position i−1 and i (i.e. before the indicated position). To note about variant annotation: a deletion of any one of a consecutive set of bases can be attributed to any of those bases. Thus, a deletion of the T at position −1 is the same sequence as a deletion of the T at position 0. 'counts' indicates the sequencing-depth normalized read count per sequence per sample. Technical replicates were combined by taking the geometric mean. 'log 2enrichment' gives the median enrichment (using a pseudocount of 10) across each context, or across all samples, after merging for technical replicates. The naive read count was averaged (geometric) between the D2_N and D3_N samples. Finally, the 'log 2enrichment_err' gives the 'confidence interval' on the mean log 2 enrichment. It is the standard deviation of the enrichment across samples *2/sqrt of the number of samples. Below, only the sequences with median log 2enrichment−log 2enrichment_err>0 are shown (2704/614564 sequences examined).

In Table 4, CI indicates confidence interval and MI indicates median enrichment, which indicates enhanced activity.

TABLE 4

Median Enrichment of DME Scaffold Variants

| index | SEQ ID NO | muts_lindexed | MI | 95% CI |
|---|---|---|---|---|
| 7240543 | 412 | 27.-.C;76.G.- | 3.390 | 2.040 |
| 7240150 | 413 | 27.-.C;75.-.C | 3.111 | 1.862 |
| 2584994 | 414 | 0.T.-;2.A.C;27.-.C | 2.997 | 1.806 |
| 2618163 | 415 | 0.T.-;2.A.C;55.-.G | 2.915 | 0.725 |
| 2655870 | 416 | 2.A.C;0.T.-;76.GG.-A | 2.903 | 0.391 |
| 2762330 | 417 | 2.A.C;0.T.-;55.-.T | 2.857 | 1.290 |
| 7247368 | 418 | 27.-.C;86.C.- | 2.835 | 1.637 |
| 2731505 | 419 | 2.A.C;0.T.-;75.-.G | 2.795 | 0.625 |
| 2729600 | 420 | 2.A.C;0.T.-;76.-.T | 2.791 | 0.628 |
| 2701142 | 421 | 2.A.C;0.T.-;87.-.T | 2.768 | 0.559 |
| 2659588 | 422 | 2.A.C;0.T.-;75.-.C | 2.733 | 0.477 |
| 2582823 | 423 | 0.T.-;2.A.C;27.-.A | 2.729 | 1.669 |
| 3000598 | 424 | 1.TA.--;76.G.- | 2.704 | 0.439 |
| 10565036 | 425 | 15.-.T;74.-.T | 2.681 | 0.808 |
| 9696472 | 426 | 28.-.T;76.GG.-T | 2.681 | 1.715 |
| 2674674 | 427 | 2.AC;0.T.-;86.-.C | 2.650 | 0.772 |
| 7254130 | 428 | 27.-.C;75.CG.-T | 2.629 | 1.755 |
| 2977442 | 429 | 1.TA.--;55.-.G | 2.629 | 0.887 |
| 2661951 | 430 | 2.A.C;0.T.-;76.G.- | 2.627 | 0.432 |
| 1937646 | 431 | 2.A.C;0.TT.--;75.-.C | 2.626 | 1.328 |
| 2232796 | 432 | 0.T.-;55.-.G | 2.607 | 0.777 |
| 2714418 | 433 | 0.T.-;2.C;81.GA.-T | 2.595 | 0.443 |
| 2700142 | 434 | 2.A.C.0.T.-;87.-.G | 2.582 | 0.608 |
| 2667512 | 435 | 2.A.C;0.T.-;77.GA.-- | 2.577 | 0.588 |
| 7239606 | 436 | 27.-.C;76.-.A | 2.566 | 1.441 |
| 10563356 | 437 | 15.-.T;75.-.G | 2.557 | 1.056 |
| 7181049 | 438 | 27.-.A;75.-.C | 2.543 | 1.893 |

TABLE 4-continued

Median Enrichment of DME Scaffold Variants

| index | SEQ ID NO | muts_lindexed | MI | 95% CI |
|---|---|---|---|---|
| 2720034 | 439 | 2.A.C;0.T.-;78.- | 2.531 | 0.492 |
| 2265581 | 440 | 0.T.-;86.-.C | 2.520 | 0.504 |
| 2256355 | 441 | 0.T.-;76.GG.-C | 2.516 | 0.942 |
| 7251229 | 442 | 27.-.C;76.-.G | 2.516 | 1.793 |
| 10281529 | 443 | 17.-.T;76.GG.-A | 2.515 | 1.104 |
| 2299702 | 444 | 0.T.-;74.-.T | 2.504 | 0.392 |
| 2670445 | 445 | 2.A.C;0.T.-;85.T.- | 2.499 | 1.225 |
| 2258816 | 446 | 0.T.-;76.G.- | 2.494 | 0.475 |
| 7241311 | 447 | 27.-.C;77.GA.-- | 2.493 | 1.595 |
| 2658150 | 448 | 2.A.C;0.T.-;76.GG.-C | 2.492 | 0.585 |
| 2734378 | 449 | 2.A.C;0.T.-;74.-.T | 2.490 | 0.485 |
| 2723181 | 450 | 2.A.C;0.T.-;76.-.G | 2.488 | 0.421 |
| 2288202 | 451 | 0.T.-;81.GA.-T | 2.487 | 0.591 |
| 2278172 | 452 | 0.T.-;89.-.C | 2.486 | 0.690 |
| 2997382 | 453 | 1.TA.--;76.GG.-A | 2.465 | 1.066 |
| 2255017 | 454 | 0.T.-;76.GG.-A | 2.463 | 0.422 |
| 2257399 | 455 | 0.T.-;75.-.C | 2.460 | 0.676 |
| 12183183 | 456 | 2.A.-;81.GA.-T | 2.459 | 0.736 |
| 7252067 | 457 | 27.-.C;76.GG.-T | 2.459 | 2.062 |
| 10525083 | 458 | 15.-.T;75.-.C | 2.448 | 1.006 |
| 7253869 | 459 | 27.-.C;74.-.T | 2.439 | 1.638 |
| 4303777 | 460 | 4.T.-;76..T | 2.435 | 0.782 |
| 2741395 | 461 | 2.A.C;0.T.-;73.A.- | 2.435 | 0.633 |
| 7250940 | 462 | 27.-.C;78.A.- | 2.423 | 2.064 |
| 4302595 | 463 | 4.T.-;76.GG.-T | 2.422 | 0.850 |
| 4275786 | 464 | 4.T.-;87.-.T | 2.420 | 1.019 |
| 2650980 | 465 | 2.A.C;0.T.-;74.-.C | 2.414 | 0.462 |
| 2458336 | 466 | 1.TA.--;3.C.A;76.G.- | 2.411 | 1.089 |
| 10284144 | 467 | 17.-.T;76.G.- | 2.406 | 1.638 |
| 2726809 | 468 | 2.A.C;0.T.-;76.G.-;78.A.T | 2.400 | 0.556 |
| 2280896 | 469 | 0.T.-;87.-.T | 2.398 | 0.560 |
| 2673790 | 470 | 2.A.C;0.T.-;88.G.- | 2.398 | 1.017 |
| 3188700 | 471 | 0.T.-;2.A.G;27.-.C | 2.394 | 1.732 |
| 9632434 | 472 | 16.------------.CTCATTACTTTG;75.-.G | 2.394 | 1.141 |
| 3029757 | 473 | 1.TA.--;78.A.- | 2.392 | 0.524 |
| 2728393 | 474 | 2.A.C.0.T.-;76.GG.-T | 2.390 | 0.714 |
| 2300381 | 475 | 0.T.-;75.CG.-T | 2.385 | 0.948 |
| 2279969 | 476 | 0.T.-;86.C.- | 2.382 | 0.404 |
| 2260011 | 477 | 0.T.-;77.-.C | 2.379 | 0.608 |
| 2248579 | 478 | 0.T.-;72.-.C | 2.377 | 0.743 |
| 12075394 | 479 | 2.A.-;55.-.G | 2.377 | 0.679 |
| 9602743 | 480 | 28.-.C;76.GG.-C | 2.376 | 1.681 |
| 2736722 | 481 | 2.A.C;0.T.-;73.AT.-C | 2.374 | 1.104 |
| 12117240 | 482 | 2.A.-;76.GG.-A | 2.372 | 0.429 |
| 10307397 | 483 | 17.-.T;78.-.C | 2.365 | 0.868 |
| 3034775 | 484 | 1.TA.--;75.-.G | 2.360 | 0.992 |
| 12030812 | 485 | 2.A.-;27.-.A | 2.355 | 1.651 |
| 10530683 | 486 | 15.-.T86.-.A | 2.355 | 0.999 |
| 12202799 | 487 | 2.A.-;75.-.G | 2.352 | 0.508 |
| 9687168 | 488 | 28.-.T;76.GG.-A | 2.351 | 1.612 |
| 4309853 | 489 | 4.T.-;75.CG.-T | 2.344 | 0.845 |
| 4234320 | 490 | 4.T.-;75.-.C | 2.344 | 0.820 |
| 2698521 | 491 | 2.A.C;0.T.-;88.-.T | 2.339 | 0.685 |
| 2253698 | 492 | 0.T.-;75.-.A | 2.334 | 0.918 |
| 2468003 | 493 | 1.TA.--;3.C.A;75.-.G | 2.330 | 0.934 |
| 12290253 | 494 | 2.A.-;28.-.C | 2.326 | 1.588 |
| 2999382 | 495 | 1.TA.--;75.-.C | 2.315 | 0.592 |
| 3227871 | 496 | 2.A.G;0.T.-;55.-.G | 2.314 | 0.774 |
| 10521017 | 497 | 15.-.T;74.-.C | 2.314 | 0.910 |
| 10089663 | 498 | 19.-.T;75.-.G | 2.308 | 1.078 |
| 4274894 | 499 | 4.T.-;87.-.G | 2.308 | 0.512 |
| 2466567 | 500 | 1.TA.--;3.C.A;78.A.- | 2.308 | 1.291 |
| 2696261 | 501 | 2.A.C;0.T.-;89.-.C | 2.293 | 0.681 |
| 2675948 | 502 | 2.A.C;0.T.-;89.-.A | 2.289 | 1.259 |
| 10521784 | 503 | 15.-.T;74.-.G | 2.283 | 0.905 |
| 12123787 | 504 | 2.A.-;76.G.- | 2.278 | 0.492 |
| 10310335 | 505 | 17.-.T;76.GG.-T | 2.775 | 0.804 |
| 2295876 | 506 | 0.T.-;77.T | 2.273 | 0.931 |
| 2697871 | 507 | 0.T.-;2.A.C;89.-.T | 2.250 | 0.626 |
| 2735417 | 508 | 2.A.C;0.T.-;75.CG.-T | 2.249 | 0.390 |
| 2671836 | 509 | 0.T.-;2.A.C;86.-.A | 2.245 | 0.542 |
| 12033345 | 510 | 2.A.-;27.-.C | 2.235 | 1.903 |
| 2821484 | 511 | 0.T.-;2.A.C;17.-.T | 2.235 | 0.750 |
| 3033813 | 512 | 1.TA.--;76.-.T | 2.229 | 0.548 |
| 2291551 | 513 | 0.T.-;78.-.C | 2.226 | 0.532 |
| 2716457 | 514 | 2.A.C;0.T.-;80.A.- | 2.213 | 0.548 |
| 2697599 | 515 | 2.A.C;0.T.-;89.A.- | 2.209 | 1.346 |
| 12135440 | 516 | 2.A.-;87.-.A | 2.208 | 1.053 |
| 4273350 | 517 | 4.T.-;88.-.T | 2.208 | 1.013 |
| 2298121 | 518 | 0.T.-;75.-.G | 2.208 | 0.241 |
| 2652510 | 519 | 0.T.-;2.A.C;74.-.G | 2.206 | 0.613 |
| 3006640 | 520 | 1.TA.--;86.-.C | 2.206 | 0.584 |
| 10313388 | 521 | 17.-.T;74.-.T | 2.206 | 1.036 |
| 10081410 | 522 | 19.-.T;87.-.G | 2.206 | 0.589 |
| 3033236 | 523 | 1.TA.--;76.GG.-T | 2.198 | 0.669 |
| 7242523 | 524 | 27.-.C;86.-.C | 2.198 | 1.973 |
| 7254383 | 525 | 27.-.C;73.AT.-C | 2.198 | 1.510 |
| 2264531 | 526 | 0.T.-;87.-.A | 2.198 | 0.778 |
| 2727301 | 527 | 0.T.-;2.A.C;77.-.T | 2.197 | 1.323 |
| 3019306 | 528 | 1.T--;87.-.G | 2.191 | 0.534 |
| 4295725 | 529 | 4.T.-;78.A.- | 2.187 | 0.609 |
| 10311816 | 530 | 17.-.T;75.-.G | 2.187 | 1.507 |
| 12167745 | 531 | 2.A.-;87.-.G | 2.184 | 0.736 |
| 12199256 | 532 | 2.A.-;76.GG.-T | 2.179 | 0.737 |
| 6477911 | 533 | 16.-.C;75.-.G | 2.178 | 0.983 |
| 4274124 | 534 | 4.T.-;86.C.- | 2.171 | 0.474 |
| 12206105 | 535 | 2.A.-;74.-.T | 2.170 | 0.608 |
| 12166825 | 536 | 2.A.-;86.C.- | 2.168 | 0.774 |
| 11956698 | 537 | 2.AC.--;4.T.C;86.-.C | 2.164 | 1.360 |
| 2280390 | 538 | 0.T.-;87.-.G | 2.162 | 0.479 |
| 2650159 | 539 | 2.A.C;0.T.-;74.T.- | 2.161 | 0.517 |
| 10531253 | 540 | 15.-.T;87.-.A | 2.159 | 1.130 |
| 2665054 | 541 | 2.A.C;0.T.-;79.G.- | 2.158 | 0.562 |
| 8531520 | 542 | 75.-.G;86.-.C | 2.155 | 0.582 |
| 2296436 | 543 | 0.T.-;76.GG.-T | 2.154 | 0.679 |
| 4249048 | 544 | 4.T.-;86.-.C | 2.142 | 0.675 |
| 10547068 | 545 | 15.-.T;87.-.G | 2.140 | 0.857 |
| 12168820 | 546 | 2.A.-;87.-.T | 2.140 | 0.458 |
| 2466824 | 547 | 1.TA.--;3.C.A;76.-.G | 2.137 | 0.989 |
| 3036963 | 548 | 1.TA.--;75.CG.-T | 2.137 | 0.479 |
| 10522450 | 549 | 15.-.T;75.-.A | 2.135 | 1.003 |
| 10300736 | 550 | 17.-.T;87.-.T | 2.134 | 1.348 |
| 3002220 | 551 | 1.TA.--;79.G.- | 2.131 | 0.607 |
| 3030471 | 552 | 1.TA.---;76.-.G | 2.130 | 0.372 |
| 10523429 | 553 | 15.-.T;76.GG.-A | 2.130 | 0.787 |
| 1909254 | 554 | 0.TTA.---;3.C.A;75.-.G | 2.130 | 1.147 |
| 3004722 | 555 | 1.TA.--;85.T.- | 2.124 | 1.092 |
| 2672731 | 556 | 2.A.C;0.T.-;87.-.A | 2.121 | 0.898 |
| 12129733 | 557 | 2.A.-;77.GA.-- | 2.120 | 0.500 |
| 4250089 | 558 | 4.T.-;89.-.A | 2.117 | 0.998 |
| 2688981 | 559 | 2.A.C;0.T.-;99.-.G | 2.112 | 0.980 |
| 2995452 | 560 | 1.TA.--;74.-.G | 2.112 | 0.611 |
| 12114782 | 561 | 2.A.-;75.-.A | 2.110 | 0.500 |
| 2993173 | 562 | 1.TA.--;73.-.A | 2.104 | 0.697 |
| 1978344 | 563 | 0.T.C;87.-.G | 2.100 | 0.870 |
| 4294004 | 564 | 4.T.-;78.-.C | 2.099 | 0.595 |
| 10568306 | 565 | 15.-.T;73.-.A | 2.096 | 0.741 |
| 10561545 | 566 | 15.-.T;76.GG.-T | 2.095 | 0.554 |
| 2713433 | 567 | 2.A.C;0.T.-;82.AA.-T | 2.094 | 0.560 |
| 1863579 | 568 | 0.TT.--;75.-.G | 2.086 | 0.787 |
| 3006303 | 569 | 1.TA.-;88.G.- | 2.086 | 0.537 |
| 4236935 | 570 | 4.T.-;76.G.- | 2.081 | 0.919 |
| 12138801 | 571 | 2.A.-;89.-.A | 2.080 | 1.115 |
| 12164760 | 572 | 2.A.-;89.-.T | 2.080 | 0.316 |
| 10288787 | 573 | 17.-.T;86.-.C | 2.080 | 0.927 |
| 2664129 | 574 | 0.T.-;2.A.C;77.-.C | 2.079 | 0.379 |
| 2663861 | 575 | 0.T.-;2.A.C;76.G.-;78.A.C | 2.078 | 0.700 |
| 2726063 | 576 | 0.T.-;2.A.C;78.A.T | 2.078 | 0.972 |
| 4232837 | 577 | 4.T.-;76.GG-C | 2.069 | 0.580 |
| 3001791 | 578 | 1.TA.--;77.-.A | 2.063 | 0.629 |
| 2048069 | 579 | 0.TT.--;2.A.G;76.G.- | 2.059 | 1.413 |
| 2653681 | 580 | 2.A.C;0.T.-;75.-.A | 2.052 | 0.427 |
| 2265126 | 581 | 0.T.-;88.G.- | 2.050 | 0.557 |
| 2739399 | 582 | 0.T.-;2.A.C;73.A.G | 2.049 | 1.003 |
| 7250543 | 583 | 27.-.C;78.-.C | 2.047 | 1.480 |
| 2747651 | 584 | 0.T.-;2.A.C;66.CT.-- | 2.047 | 0.900 |
| 12437734 | 585 | 1.TAC.---;78.A.- | 2.043 | 0.615 |
| 2826230 | 586 | 0.T.-;2.A.C;15.-.T | 2.042 | 0.538 |
| 2709008 | 587 | 2.A.C.;0.T.-;82.A.-;84.A.T | 2.037 | 1.246 |

TABLE 4-continued

Median Enrichment of DME Scaffold Variants

| index | SEQ ID NO | muts_lindexed | MI | 95% CI |
|---|---|---|---|---|
| 3005336 | 588 | 1.TA.--;86.-.A | 2.034 | 0.483 |
| 4301274 | 589 | 4.T.-;76.G.-;78.A.T. | 2.028 | 0.873 |
| 3018865 | 590 | 1.TA.--;86.C.- | 2.025 | 0.616 |
| 2699310 | 591 | 2.A.C;0.T.-;86.C- | 2.023 | 0.564 |
| 2279026 | 592 | 0.T.-;89.A.- | 2.022 | 1.568 |
| 7248209 | 593 | 27.-.C;82.A.- | 2.022 | 1.627 |
| 10562113 | 594 | 15.-.T;76.-.T | 2.020 | 0.858 |
| 7181373 | 595 | 27.-.A;76.G.- | 2.014 | 1.908 |
| 10559019 | 596 | 15.-.T;76.-.G | 2.014 | 0.753 |
| 3018452 | 597 | 1.TA.--;88.-.T | 2.013 | 0.626 |
| 12118457 | 598 | 2.A.-;76.-.A | 2.011 | 1.170 |
| 2805043 | 599 | 2.A.C;0.T.-;28.-C | 2.010 | 1.524 |
| 4242379 | 600 | 4.T.-;77.GA.-- | 2.008 | 0.985 |
| 2259846 | 601 | 0.T.-;76.G.-;78.A.C | 2.005 | 0.640 |
| 6462092 | 602 | 16.-.C;87.-.A | 2.001 | 0.983 |
| 4312495 | 603 | 4.T.-;73.AT.-G | 1.997 | 0.708 |
| 2668714 | 604 | 0.T.-;2.A.C;81.GA.-C | 1.996 | 0.678 |
| 2294477 | 605 | 0.T.-;78.AG.-T | 1.994 | 0.703 |
| 12198135 | 606 | 2.A.-;77.-.T | 1.994 | 1.433 |
| 4238150 | 607 | 4.T.-;77.-.A | 1.993 | 0.762 |
| 3019738 | 608 | 1.TA.--.87.-.T | 1.992 | 0.532 |
| 2352050 | 609 | 0.T.-;17.-.T | 1.991 | 0.852 |
| 2705912 | 610 | 2.A.C;0.T.-;83.-.C | 1.990 | 0.585 |
| 6478822 | 611 | 16.-.C;74.-.T | 1.989 | 0.477 |
| 2665913 | 612 | 2.A.C;0.T.-;79.GA.-C | 1.987 | 1.186 |
| 3331447 | 613 | 2.A.G;0.T.-;76.GG.-T | 1.985 | 0.958 |
| 3186538 | 614 | 2.A.G;0.T.-;27.-.A | 1.983 | 1.530 |
| 2738784 | 615 | 2.A.C.0.T.-;73.AT.-G | 1.977 | 0.623 |
| 7832272 | 616 | 55.-.G | 1.977 | 0.882 |
| 4297458 | 617 | 4.T.-;76.-.G | 1.976 | 0.997 |
| 3334291 | 618 | 2.A.G;0.T.-;75.-.G | 1.975 | 0.654 |
| 2212416 | 619 | 0.T.-;27.-.C | 1.974 | 1.458 |
| 8752897 | 620 | 55.-.T;76.G.- | 1.972 | 0.468 |
| 2293333 | 621 | 0.T.-;76.-.G | 1.970 | 0.514 |
| 7180386 | 622 | 27.-.A;76.GG.-A | 1.969 | 1.667 |
| 2996180 | 623 | 1.TA.--;75.-.A | 1.967 | 0.476 |
| 7238423 | 624 | 27.-.C;74.T.- | 1.963 | 1.563 |
| 2261752 | 625 | 0.T.-;77.GA.-- | 1.962 | 0.503 |
| 10282247 | 626 | 17.-.T;76.GG.-C | 1.960 | 0.719 |
| 4230973 | 627 | 4.T.-;76.GG.-A | 1.958 | 0.723 |
| 4276520 | 628 | 4.T.-;86.-.G | 1.958 | 0.901 |
| 2675193 | 629 | 0.T.-;2.A.C;88.GA.-C | 1.957 | 0.878 |
| 13101476 | 630 | -1.GT.--;75.-.G | 1.952 | 0.439 |
| 7203209 | 631 | 27.G.-;76.GG.-C | 1.952 | 1.709 |
| 2724398 | 632 | 0.T.-;2.A.C;78.A.G | 1.947 | 0.801 |
| 10309365 | 633 | 17.-.T;78.-.T | 1.947 | 1.542 |
| 10520418 | 634 | 15.-.T;74.T.- | 1.945 | 0.728 |
| 10300394 | 635 | 17.-.T;87.-.G | 1.944 | 1.037 |
| 4248302 | 636 | 4.T.-;88.G.- | 1.937 | 0.857 |
| 7240856 | 637 | 27.-.C;76.G.-;78.A.C | 1.937 | 1.188 |
| 4313003 | 638 | 4.T.-;73.A.G | 1.935 | 0.688 |
| 2467599 | 639 | 1.TA.--;3.C.A;76.GG.-T | 1.923 | 1.105 |
| 2279202 | 640 | 0.T.-;89.-.T | 1.921 | 0.709 |
| 2259410 | 641 | 0.T.-;77.-.A | 1.920 | 0.417 |
| 4305674 | 642 | 4.T.-;75.-.G | 1.915 | 1.089 |
| 6459602 | 643 | 16.-.C;7G- | 1.915 | 0.642 |
| 2701869 | 644 | 0.T.-;2.A;86.-.G | 1.914 | 0.477 |
| 2252978 | 645 | 0.T.-;74.-.G | 1.911 | 0.602 |
| 6470049 | 646 | 16.-.C;87.-.G | 1.910 | 0.715 |
| 12134362 | 647 | 2.A.-;86.-.A | 1.907 | 0.661 |
| 12209524 | 648 | 2.A.-;73.A.C | 1.901 | 1.154 |
| 2260529 | 649 | 0.T.-;79.G.- | 1.900 | 0.829 |
| 2690549 | 650 | 0.T.-;2.A.C;98.-.T | 1.899 | 0.954 |
| 10073100 | 651 | 19.-.T;88.G.- | 1.898 | 0.782 |
| 4239969 | 652 | 4.T.-;79.G.- | 1.898 | 0.794 |
| 3026047 | 653 | 1.TA.--;81.GA.-T | 1.896 | 0.555 |
| 3003294 | 654 | 1.TA.--;77.GA.-- | 1.896 | 0.506 |
| 12121216 | 655 | 2.A.-;75.-.C | 1.895 | 0.610 |
| 2696635 | 656 | 0.T.-;2.A.C;89.AT.-G | 1.894 | 0.882 |
| 12130978 | 657 | 2.A.-;81.GA.-C | 1.891 | 0.936 |
| 6475473 | 658 | 16.-.C;78.A.- | 1.889 | 0.581 |
| 1853356 | 659 | 0.TT.--;76.G.- | 1.885 | 0.802 |
| 8544082 | 660 | 75.-.G;87.-.G | 1.884 | 0.536 |
| 2884429 | 661 | 1.-.C;76.G.- | 1.884 | 0.673 |
| 63955 | 662 | 17.-.A;76.-.G | 1.882 | 0.843 |
| 2746170 | 663 | 2.A.C;0.T.-;66.CT.-G | 1.880 | 0.517 |
| 4226314 | 664 | 4.T.-;74.-.C | 1.874 | 0.901 |
| 6304607 | 665 | 16.-.A;76.G.- | 1.873 | 0.523 |
| 2583788 | 666 | 0.T.-;2.A.C;27.G.- | 1.873 | 1.388 |
| 2255694 | 667 | 0.T.-;76.-.A | 1.869 | 0.837 |
| 7249882 | 668 | 27.-.C;80.A.- | 1.867 | 1.645 |
| 10069481 | 669 | 19.-.T;75.-.C | 1.864 | 0.645 |
| 2643173 | 670 | 0.T.-;2.A.C;70.T.- | 1.864 | 1.689 |
| 12749699 | 671 | 0.-.T;75.-.G | 1.863 | 0.757 |
| 7208859 | 672 | 27.G.-;87.-.G | 1.862 | 1.687 |
| 4271233 | 673 | 4.T.-;89.-.C | 1.854 | 0.839 |
| 6455215 | 674 | 16.-.C;73.-.A | 1.850 | 0.825 |
| 2816525 | 675 | 0.T.-;2.A.C;19.-.T | 1.848 | 0.369 |
| 2292594 | 676 | 0.T.-;78.A.- | 1.846 | 0.313 |
| 2287708 | 677 | 0.T.-;82.AA.-T | 1.846 | 0.408 |
| 2721779 | 678 | 2.A.C;0.T.-;78.A.- | 1.842 | 0.677 |
| 1945942 | 679 | 0.TT.--;2.A.C;75.-.G | 1.842 | 1.271 |
| 12111705 | 680 | 2.A.-;74.-.C | 1.841 | 0.669 |
| 2567750 | 681 | 0.T.-;2.A.C;16.-.C | 1.840 | 0.427 |
| 2463364 | 682 | 1.TA.--;3.C.A;87.-.G | 1.839 | 0.821 |
| 3031594 | 683 | 1.TA.--;78.AG.-T | 1.839 | 0.620 |
| 10199376 | 684 | 18.-.G;75.-.G | 1.837 | 1.238 |
| 4272444 | 685 | 4.T.-;89.A.- | 1.837 | 0.998 |
| 9610515 | 686 | 28.-.C;78.A.- | 1.836 | 1.802 |
| 2737747 | 687 | 0.T.-;2.A.C;73.A.C | 1.833 | 1.293 |
| 12113430 | 688 | 2.A.-;74.-.G | 1.828 | 0.753 |
| 10530413 | 689 | 15.-.T;85.TC.-G | 1.825 | 1.155 |
| 12176759 | 690 | 2.A.-;83.-.T | 1.824 | 1.046 |
| 12127185 | 691 | 2.A.-;79.G.- | 1.824 | 0.606 |
| 4288099 | 692 | 4.T.-;81.GA.-T | 1.824 | 0.753 |
| 12196850 | 693 | 2.A.-;78.A.T | 1.821 | 1.086 |
| 6457366 | 694 | 16.-.C;75.-.A | 1.821 | 0.638 |
| 12105140 | 695 | 2.A.-;72.-.C | 1.818 | 0.700 |
| 1944577 | 696 | 0.TT.--;2.A.C;78.A.- | 1.817 | 1.170 |
| 4293546 | 697 | 4.T.-;78.AG.-C | 1.816 | 1.015 |
| 9996838 | 698 | 19.-.G;74.-.T | 1.814 | 0.800 |
| 10301024 | 699 | 17.-.T;86.-.G | 1.814 | 0.967 |
| 2308228 | 700 | 0.T.-;66.C.- | 1.811 | 0.756 |
| 7835938 | 701 | 55.-.G;75.-.G | 1.811 | 1.112 |
| 3005841 | 702 | 1.TA.--;87.-.A | 1.811 | 0.806 |
| 12169698 | 703 | 2.A.-;86.-.G | 1.808 | 0.857 |
| 3028597 | 704 | 1.TA.--;78.AG.-C | 1.803 | 0.743 |
| 7191855 | 705 | 27.-.A;75.CG.-T | 1.802 | 1.430 |
| 9972503 | 706 | 19.-.G;74.T.- | 1.802 | 0.750 |
| 4026979 | 707 | 3.-.C;75.-.G | 1.802 | 1.374 |
| 7180118 | 708 | 27.-.A;75.-.A | 1.801 | 1.525 |
| 10081203 | 709 | 19.-.T;86.C.- | 1.799 | 0.502 |
| 10532156 | 710 | 15.-.T;86.-.C | 1.797 | 1.070 |
| 2749667 | 711 | 2.A.C;0.T.-;65.GC.-T | 1.795 | 0.642 |
| 129228 | 712 | 2.A.-;90.-.C | 1.794 | 1.201 |
| 10288547 | 713 | 17.-.T.88.G.- | 1.794 | 1.193 |
| 4331367 | 714 | 4.T.-;55.-.T | 1.793 | 0.481 |
| 2725463 | 715 | 2.A.C;0.T.-;78.-.T | 1.792 | 0.507 |
| 2718857 | 716 | 0.T.-;2.A.C;79.GA.-T | 1.792 | 0.900 |
| 2247247 | 717 | 0.T.-;72.-.A | 1.792 | 0.887 |
| 12125011 | 718 | 2.A.-;77.-.A | 1.786 | 0.527 |
| 4225246 | 719 | 4.T.-;74.T.- | 1.786 | 0.629 |
| 12165722 | 720 | 2.A.-;88.-.T | 1.786 | 1.273 |
| 2733129 | 721 | 0.T.-;2.A.C;75.C.- | 1.786 | 0.561 |
| 2469676 | 722 | 1.TA.--;3.C.A;73.A.- | 1.785 | 1.174 |
| 3018172 | 723 | 1.TA.--;89.-.T | 1.785 | 0.757 |
| 12196709 | 724 | 2.A.-;78.-.T | 1.782 | 0.754 |
| 9612063 | 725 | 28.-.C;74.-.T | 1.782 | 1.618 |
| 10547909 | 726 | 15.-.T;86.-.G | 1.781 | 0.818 |
| 12194342 | 727 | 2.A.-;78.A.-;80.A.- | 1.780 | 1.289 |
| 4228855 | 728 | 4.T.-;75.-.A | 1.776 | 0.897 |
| 10546613 | 729 | 15.-.T;86.C.- | 1.776 | 0.859 |
| 10547538 | 730 | 15.-.T;87.-.T | 1.772 | 1.080 |
| 10519772 | 731 | 15.-.T;73.-.A | 1.771 | 0.624 |
| 8510297 | 732 | 77.G.T | 1.770 | 1.239 |
| 12119606 | 733 | 2.A.-;76.GG.-C | 1.768 | 1.110 |
| 2669299 | 734 | 0.T.-;2.A.C.85.TC.-A | 1.767 | 0.842 |
| 6469807 | 735 | 16.-.C;86.C.- | 1.765 | 0.759 |
| 10197299 | 736 | 18.-.G;76.-.G | 1.764 | 0.832 |
| 3344225 | 737 | 2.A.G;0.T.-;73.A.- | 1.762 | 1.216 |

TABLE 4-continued

Median Enrichment of DME Scaffold Variants

| index | SEQ ID NO | muts_lindexed | MI | 95% CI |
|---|---|---|---|---|
| 2456917 | 738 | 1.TA.--;3.C.A;75.-.A | 1.761 | 1.203 |
| 10307233 | 739 | 17.-.T;78.AG.-C | 1.760 | 1.101 |
| 12314352 | 740 | 2.A.-;15.-.T | 1.758 | 0.436 |
| 12177388 | 741 | 2.A.-;82.AA.-- | 1.751 | 0.615 |
| 2694455 | 742 | 0.T.-;2.A.C;91.A.-;93.A.G | 1.751 | 1.015 |
| 3040066 | 743 | 1.TA.--;73.A.- | 1.750 | 0.690 |
| 10081633 | 744 | 19.-.T;87.-.T | 1.750 | 0.917 |
| 4246508 | 745 | 4.T.-;86.-.A | 1.749 | 0.939 |
| 4301580 | 746 | 4.T.-;77.-.T | 1.744 | 0.701 |
| 10181172 | 747 | 18.-.G;75.-.A | 1.743 | 1.016 |
| 12200668 | 748 | 2.A.-;76.-.T | 1.741 | 0.873 |
| 10524336 | 749 | 15.-.T;76.GG.-C | 1.738 | 0.390 |
| 3007212 | 750 | 1.TA.--;89.-.A | 1.738 | 1.072 |
| 10526271 | 751 | 15.-.T;76.G.- | 1.738 | 1.098 |
| 10561166 | 752 | 15.-.T;77.-.T | 1.737 | 0.745 |
| 2663037 | 753 | 2.A.C;0.T.-;77.-.A | 1.732 | 0.417 |
| 12136525 | 754 | 2.A.;88.G.- | 1.731 | 0.578 |
| 8758832 | 755 | 55.-.T;78.A.- | 1.731 | 0.641 |
| 1864295 | 756 | 0.TT.--;75.CG.-T | 1.729 | 0.424 |
| 10550736 | 757 | 15.-.T;82.A.-;84.A.G | 1.728 | 0.888 |
| 2657071 | 758 | 2.A.C;0.T.-;76.-.A | 1.728 | 1.206 |
| 2059338 | 759 | 0.TT.--;2.A.G;75.-.G | 1.725 | 1.054 |
| 12182224 | 760 | 2.A.-;82.AA.-T | 1.722 | 0.599 |
| 2671130 | 761 | 2.A.C;0.T.-;85.TC.-G | 1.721 | 0.884 |
| 4200182 | 762 | 4.T.-;55.-.G | 1.721 | 1.233 |
| 2281298 | 763 | 0.T.-;86.-.G | 1.720 | 0.460 |
| 7182097 | 764 | 27.-.A;77.GA.-- | 1.719 | 1.318 |
| 2251662 | 765 | 0.T.-;74.T.- | 1.719 | 0.428 |
| 1904870 | 766 | 0.TTA.---;3.C.A;76.G.- | 1.715 | 1.345 |
| 10553996 | 767 | 15.-.T;81.GA.-T | 1.715 | 0.963 |
| 10202590 | 768 | 18.-.G;73.A.- | 1.715 | 0.822 |
| 3028839 | 769 | 1.TA.--;78.-.C | 1.713 | 0.450 |
| 3304552 | 770 | 0.T.-;2.A.G;89.-.T | 1.713 | 0.767 |
| 4247308 | 771 | 4.T.-;87.-.A | 1.711 | 0.766 |
| 4318521 | 772 | 4.T.-;66.CT.-G | 1.710 | 0.957 |
| 7247759 | 773 | 27.-.C;86.-.G | 1.710 | 1.198 |
| 10198320 | 774 | 18.-.G;76.GG.-T | 1.709 | 0.701 |
| 2457655 | 775 | 1.TA.-.3.C.A;76.GG.-C | 1.709 | 1.260 |
| 3032520 | 776 | 1.TA.--;76.G.-;78.A.T | 1.709 | 0.754 |
| 2702792 | 777 | 0.T.-2;A.C;86.CC.-T | 1.709 | 0.742 |
| 12171374 | 778 | 2.A.-;84.AT.-- | 1.709 | 1.239 |
| 10192666 | 779 | 18.-.G;87.-.G | 1.706 | 0.672 |
| 2642318 | 780 | 2.A.C;0.T.-;72.-.A | 1.703 | 0.651 |
| 2718074 | 781 | 2.A.C;0.T.-;77.GA.--82.A.T | 1.700 | 1.191 |
| 12191670 | 782 | 2.A.-;78.A.- | 1.697 | 0.819 |
| 2456219 | 783 | 1.TA.--;3.C.A;74.T.- | 1.696 | 1.260 |
| 2457365 | 784 | 1.TA.--;3.C.A;76.GG.-A | 1.695 | 0.951 |
| 8538180 | 785 | 75.-.G | 1.695 | 0.416 |
| 3020581 | 786 | 1.TA.--;86.CC.-T | 1.693 | 1.160 |
| 10281916 | 787 | 17.-.T;76.-.A | 1.693 | 0.649 |
| 2707684 | 788 | 0.T.-;2.A.C;82.A.-;84.A.G | 1.692 | 1.346 |
| 2676761 | 789 | 0.T.-;2.A.C;90.-.G | 1.689 | 1.000 |
| 7213979 | 790 | 27.G.-;75.CG.-T | 1.689 | 1.195 |
| 2459101 | 791 | 1.TA.--;3.C.A;77.GA.-- | 1.687 | 0.967 |
| 8123571 | 792 | 75.-.C;86.-.C | 1.686 | 0.454 |
| 12207287 | 793 | 2.A.-;75.CG.-T | 1.685 | 0.564 |
| 2740245 | 794 | 2.A.C;0.T.-;70.-.T | 1.685 | 1.013 |
| 10531744 | 795 | 15.-.T;88.G.- | 1.685 | 1.172 |
| 2669798 | 796 | 2.A.C;0.T.-;82.-.A | 1.684 | 0.486 |
| 2294771 | 797 | 0.T.-;78.-.T | 1.684 | 0.366 |
| 7213033 | 798 | 27.G.-;76.GG.-T | 1.687 | 1.554 |
| 7829581 | 799 | 55.-.G;76.G.- | 1.682 | 1.158 |
| 2808092 | 800 | 0.T.-;2.A.C;28.-.T | 1.680 | 1.571 |
| 2960043 | 801 | 1.TA.--;27.-.C | 1.676 | 1.353 |
| 10506564 | 802 | 15.-.T;55.-.G | 1.675 | 1.443 |
| 4315349 | 803 | 4.T.-;73.A.T | 1.668 | 0.705 |
| 2705067 | 804 | 2.A.C;0.T.-;82.A.- | 1.668 | 0.498 |
| 3330280 | 805 | 0.T.-;2.A.G;76.G.-;78.A.T | 1.667 | 0.948 |
| 9630969 | 806 | 16.-----------.CTCATTACTTTG;75.-.A | 1.665 | 1.315 |
| 12173513 | 807 | 2.A.-;82.A.- | 1.664 | 0.734 |
| 3280346 | 808 | 0.T.-;2.A.C;87.-.A | 1.663 | 1.204 |
| 7238549 | 809 | 27.-.C;74.-.C | 1.661 | 1.215 |
| 8154695 | 810 | 76.G.-;78.A.C | 1.661 | 0.368 |
| 10516784 | 811 | 15.-.T;72.-.A | 1.660 | 0.597 |
| 10307953 | 812 | 17.-.T;78.A.- | 1.660 | 0.824 |
| 12432835 | 813 | 1.TAC.---;75.-.C | 1.654 | 0.814 |
| 12193344 | 814 | 2.A.-;76.-.G | 1.654 | 0.664 |
| 2297191 | 815 | 0.T.-;76.-.T | 1.652 | 0.458 |
| 2126158 | 816 | 0.TTA.---;3.C.G;87.-.G | 1.650 | 1.318 |
| 2283617 | 817 | 0.T.-;83.-.C | 1.649 | 1.421 |
| 2654520 | 818 | 2.A.C;0.T.-;75.CG.-A | 1.647 | 0.574 |
| 3332543 | 819 | 0.T.-;2.A.G;76.-.T | 1.645 | 0.844 |
| 9604425 | 820 | 28.-.C;88.G.- | 1.644 | 1.218 |
| 12109255 | 821 | 2.A.-;73.-.A | 1.644 | 0.930 |
| 12438229 | 822 | 1.TAC.---;76.GG.-T | 1.642 | 0.689 |
| 8153054 | 823 | 77.G.C | 1.641 | 1.385 |
| 10308482 | 824 | 17.-.T;76.-.G | 1.641 | 1.127 |
| 10300026 | 825 | 17.-.T;86.C.- | 1.641 | 1.228 |
| 2715234 | 826 | 2.A.C;0.T.-;80.AG.-C | 1.640 | 1.476 |
| 10532541 | 827 | 15.-.T;90.T.- | 1.640 | 1.020 |
| 12721860 | 828 | 0.-.T;76.G.- | 1.640 | 0.367 |
| 2460008 | 829 | 1.TA.--;3.C.A;86.-.C | 1.639 | 0.936 |
| 2264044 | 830 | 0.T.-;86.-.A | 1.639 | 0.512 |
| 12188811 | 831 | 2.A.-;78.AG.-C | 1.638 | 0.776 |
| 12432569 | 832 | 1.TAC.---;76.GG.-A | 1.637 | 0.883 |
| 9602947 | 833 | 28.-.C;75.-.C | 1.636 | 1.558 |
| 2994003 | 834 | 1.TA.--;74.T.- | 1.634 | 0.542 |
| 12213405 | 835 | 2.A.-;73.A.- | 1.634 | 0.736 |
| 2719575 | 836 | 0.T.-;2.A.C;78.AG.-C | 1.633 | 0.446 |
| 2123173 | 837 | 0.TTA.---;3.C.G;76.G.- | 1.632 | 1.511 |
| 10086342 | 838 | 19.-.T;78.-.C | 1.631 | 0.477 |
| 12236371 | 839 | 2.A.-;55.-.T | 1.630 | 0.850 |
| 6473588 | 840 | 16.-.C;81.GA.-T | 1.628 | 0.398 |
| 7240999 | 841 | 27.-.C;79.G.- | 1.628 | 1.310 |
| 12189370 | 842 | 2.A.-;78.-.C | 1.625 | 0.715 |
| 3005003 | 843 | 1.TA.--;85.TC.-G | 1.625 | 0.820 |
| 10185851 | 844 | 18.-.G;86.-.C | 1.622 | 0.770 |
| 2725020 | 845 | 0.T.-;2.A.C;78.AG.-T | 1.622 | 0.696 |
| 12212274 | 846 | 2.A.-;70.-.T | 1.621 | 1.038 |
| 8470264 | 847 | 78.-.C | 1.617 | 0.272 |
| 2286841 | 848 | 0.T.-;82.AA.-G | 1.617 | 0.606 |
| 7241506 | 849 | 27.-.C;81.GA.-C | 1.617 | 1.112 |
| 12163987 | 850 | 2.A.-;89.A.G | 1.617 | 0.718 |
| 3364655 | 851 | 0.T.-;2.A.G;55.-.T | 1.615 | 1.131 |
| 1904771 | 852 | 0.TTA.---;3.C.A;75.-.C | 1.614 | 0.965 |
| 2712438 | 853 | 2.A.C;0.T.-;82.-.T | 1.612 | 0.769 |
| 14645004 | 854 | -29.A.C;0.T.-;2.A.C;76.G.- | 1.610 | 0.433 |
| 10322550 | 855 | 17.-.T;55.-.T | 1.608 | 0.835 |
| 10304965 | 856 | 17.-.T;82.AA.-T | 1.606 | 1.006 |
| 10279228 | 857 | 17.-.T;74.-.C | 1.603 | 0.965 |
| 3263089 | 858 | 2.A.G;0.T.-;74.-.G | 1.603 | 0.944 |
| 2282393 | 859 | 0.T.-;82.A.-;85.T.G | 1.602 | 1.047 |
| 2463251 | 860 | 1.TA.--;3.C.A;86.C.- | 1.598 | 0.959 |
| 2459897 | 861 | 1.TA.--;3.C.A;88.G.- | 1.596 | 0.725 |
| 1852430 | 862 | 0.TT.--;76.GG.-A | 1.596 | 0.848 |
| 10305251 | 863 | 17.-.T;81.GA.-T | 1.593 | 1.079 |
| 9603904 | 864 | 28.-.C;85.TC.-A | 1.593 | 1.339 |
| 4319798 | 865 | 4.T.-;66.CT.-- | 1.593 | 0.719 |
| 3042484 | 866 | 1.TA.--;66.CT.-G | 1.592 | 0.578 |
| 8544184 | 867 | 75.-.G;87.-.T | 1.592 | 0.631 |
| 2709867 | 868 | 2.A.C;0.T.-;82.AA.-C | 1.500 | 0.506 |
| 3439310 | 869 | 0.T.-;2.A.G;15.-.T | 1.589 | 0.341 |
| 2718364 | 870 | 0.T.-;2.A.C;80.A.T | 1.588 | 1.149 |
| 4223967 | 871 | 4.T.-;73.-.A | 1.587 | 0.646 |
| 4271617 | 872 | 4.T.-;89.AT.-G | 1.587 | 1.233 |
| 10460501 | 873 | 16.C.-;76.GG.-A | 1.587 | 0.788 |
| 4227764 | 874 | 4.T.-;74.-.G | 1.586 | 0.680 |
| 9994855 | 875 | 19.-.G;76.GG.-T | 1.585 | 0.779 |
| 3272821 | 876 | 2.A.G;0.T.-;76.G.-;78.A.C | 1.583 | 0.912 |
| 12110708 | 877 | 2.A.-;74.T.- | 1.582 | 0.659 |
| 1975319 | 878 | 0.T.C;76.G.- | 1.581 | 0.610 |
| 10316332 | 879 | 17.-.T;73.A.- | 1.581 | 0.902 |
| 2720616 | 880 | 0.T.-;2.A.C;78.A.C | 1.581 | 0.565 |
| 8753785 | 881 | 55.-.T;86.-.C | 1.581 | 0.908 |
| 8112378 | 882 | 76.-.A | 1.580 | 0.965 |
| 2819005 | 883 | 0.T.-;2.A.C;18.-.G | 1.579 | 0.491 |
| 8357828 | 884 | 87.-.G | 1.579 | 0.261 |
| 6477023 | 885 | 16.-.C;76.GG.-T | 1.577 | 0.802 |
| 12737747 | 886 | 0.-.T;87.-.G | 1.577 | 0.587 |

TABLE 4-continued

Median Enrichment of DME Scaffold Variants

| index | SEQ ID NO | muts_lindexed | MI | 95% CI |
|---|---|---|---|---|
| 12309294 | 887 | 2.A.-;17.-.T | 1.576 | 0.644 |
| 2252133 | 888 | 0.T.-;74.-.C | 1.576 | 0.340 |
| 10567192 | 889 | 15.-.T;73.AT.-G | 1.575 | 0.657 |
| 3261438 | 890 | 2.A.G;0.T.-;74.-.C | 1.575 | 0.783 |
| 15169229 | 891 | -29.A.G;75.-.G | 1.574 | 0.382 |
| 6128804 | 892 | 14.-.A;76.GG.-T | 1.574 | 0.980 |
| 12197720 | 893 | 2.A.-;76.G.-;78.A.T. | 1.573 | 0.893 |
| 3326919 | 894 | 2.A.G;0.T.-;76.-.G | 1.573 | 0.783 |
| 12164376 | 895 | 2.A.-;89.A.- | 1.572 | 1.400 |
| 2990209 | 896 | 1.TA.---;70.T.- | 1.571 | 1.474 |
| 8538220 | 897 | 75.-.G;132.G.T | 1.571 | 0.465 |
| 10068467 | 898 | 19.-.T;76.GG.-A | 1.570 | 0.904 |
| 9697533 | 899 | 28.-.T;75.CG.-T | 1.569 | 1.330 |
| 2958993 | 900 | 1.TA.---;27.-.A | 1.568 | 1.255 |
| 3001629 | 901 | 1.TA.---;76.G.-;78.A.C | 1.566 | 0.524 |
| 4291732 | 902 | 4.T.-;77.GA.---;82.A.T | 1.565 | 1.310 |
| 4238868 | 903 | 4.T.-;76.G.-;78.A.C | 1.564 | 0.830 |
| 3306461 | 904 | 0.T.-2.A.G;87.-.G | 1.564 | 0.717 |
| 1937976 | 905 | 2.A.C;0.TT.---;76.G.- | 1.560 | 1.463 |
| 4172716 | 906 | 4.T.-;27.-.C | 1.558 | 1.388 |
| 12185288 | 907 | 2.A.-;80.A.- | 1..557 | 0.706 |
| 14813579 | 908 | -29.A.C;75.-.G | 1.557 | 0.415 |
| 2468675 | 909 | 1.TA.---;3.C.A;75.CG-T | 1.553 | 0.931 |
| 12195510 | 910 | 2.A.-78.AG.-T | 1.550 | 0.887 |
| 4285997 | 911 | 4.T.-;82.AA.-G | 1.549 | 0.782 |
| 3275841 | 912 | 2.A.G;0.T.-;77.GA.-- | 1.549 | 0.526 |
| 3018032 | 913 | 1.TA.---89.A.- | 1.549 | 1.114 |
| 2301817 | 914 | 0.T.-;73.A.C | 1.549 | 0.917 |
| 3305057 | 915 | 0.T.-;2.A.G;88.-.T | 1.548 | 0.420 |
| 2122618 | 916 | 0.TTA.---;3.C.G;76.GG.-A | 1.548 | 1.094 |
| 2289325 | 917 | 0.T.-;80.A.- | 1.547 | 0.393 |
| 4291562 | 918 | 4.T.-;80.AG.-T | 1.547 | 1.017 |
| 10557226 | 919 | 15.-.T;78.-.C | 1.545 | 0.975 |
| 12748115 | 920 | 0.-.T;76.GG.-T | 1.545 | 0.710 |
| 3026518 | 921 | 1.TA.---;80.AG.-C | 1.544 | 1.241 |
| 10545028 | 922 | 15.-.T;89.-.C | 1.542 | 0.579 |
| 3416823 | 923 | 0.T.-;2.A.G;28.-.C | 1.539 | 1.436 |
| 9976094 | 924 | 19.-.G;76.G.- | 1.539 | 0.749 |
| 1852751 | 925 | 0.TT.---;76.GG.-C | 1.537 | 0.770 |
| 4314686 | 926 | 4.T.-;73.A.- | 1.536 | 1.014 |
| 6470272 | 927 | 16.-.C;87.-.T | 1.536 | 0.597 |
| 2673006 | 928 | 0.T.-;2.A.C;87.C.A | 1.535 | 0.804 |
| 12137377 | 929 | 2.A.-;86.-.C | 1.535 | 0.546 |
| 12184036 | 930 | 2.A.-;80.AG.-C | 1.532 | 1.352 |
| 10285242 | 931 | 17.-.T;77.-.C | 1.530 | 1.164 |
| 2263017 | 932 | 0.T.-;82.-.A | 1.530 | 0.468 |
| 12163286 | 933 | 2.A.-;89.AT.-G | 1.529 | 1.001 |
| 2706481 | 934 | 2.A.C;0.T.-;82.A.-;84.A.C | 1.528 | 1.209 |
| 4320578 | 935 | 4.T.-66.C.- | 1.527 | 0.995 |
| 3004121 | 936 | 1.TA.---;85.TC.-A | 1.526 | 0.698 |
| 3269260 | 937 | 2.A.G;0.T.-;75.-.C | 1.522 | 0.739 |
| 7835518 | 938 | 55.-.G;76.-.G | 1.519 | 0.935 |
| 10195401 | 939 | 18.-.G;81.GA.-T | 1.519 | 0.776 |
| 6477333 | 940 | 16.-.C;76.-.T | 1.516 | 0.627 |
| 4171307 | 941 | 4.T.-;27.-.A | 1.514 | 1.234 |
| 10299590 | 947 | 17.-.T;88.-.T | 1.513 | 1.296 |
| 6478447 | 943 | 16.-.C;75.C.- | 1.512 | 0.508 |
| 4249490 | 944 | 4.T.-;88.GA.-C | 1.512 | 0.737 |
| 12220656 | 945 | 2.A.-;66.C.- | 1.512 | 1.055 |
| 7240739 | 946 | 27.-.C;77.-.A | 1.512 | 1.178 |
| 10315246 | 947 | 17.-.T;73.AT.-G | 1.511 | 1.010 |
| 1944754 | 948 | 0.TT.---;2.A.C;76.-.G | 1.511 | 1.156 |
| 3337255 | 949 | 2.A.G;0.T.-;74.-.T | 1.510 | 0.678 |
| 6362999 | 950 | 17.-.A.76.G.- | 1.509 | 1.043 |
| 3017407 | 951 | 1.TA.---;89.-.C | 1.509 | 0.465 |
| 9973601 | 952 | 19.-.G;75.-.A | 1.503 | 0.894 |
| 12186826 | 953 | 2.A.-;80.AG.-T | 1.501 | 0.813 |
| 3035711 | 954 | 1.TA.---;75.C.- | 1.500 | 0.592 |
| 8526584 | 955 | 76.-.T | 1.499 | 0.320 |
| 2211100 | 956 | 0.T.-;27.-.A | 1.499 | 1.300 |
| 8558515 | 957 | 74.-.T | 1.499 | 0.244 |
| 4321895 | 958 | 4.T.-;65.GC.-T | 1.498 | 0.661 |
| 12204638 | 959 | 2.A.-;75.C.- | 1.496 | 0.655 |
| 8118238 | 960 | 76.GG.-C | 1.495 | 0.555 |
| 2348592 | 961 | 0.T.-;19.-.T | 1.493 | 0.463 |
| 3282394 | 962 | 0.T.-;2.A.G;88.GA.-C | 1.491 | 1.144 |
| 9974216 | 963 | 19.-.G;76.GG.-A | 1.490 | 0.650 |
| 3435006 | 964 | 0.T.-;2.A.G;17.-.T | 1.488 | 0.572 |
| 2291281 | 965 | 0.T.-;78.AG.-C | 1.486 | 0.722 |
| 3013663 | 966 | 1.TA.---;99.-.G | 1.484 | 0.730 |
| 7255023 | 967 | 27.-.C;70.-.T | 1.484 | 1.384 |
| 4307384 | 968 | 4.T.-;75.C.- | 1.483 | 0.592 |
| 2702279 | 969 | 0.T.-;2.A.C;86.CC.-G | 1.482 | 1.155 |
| 3036396 | 970 | 1.TA.---;74.-.T | 1.480 | 0.455 |
| 10196645 | 971 | 18.-.G;78.-.C | 1.479 | 0.758 |
| 4308690 | 972 | 4.T.-;74.-.T | 1.479 | 0.955 |
| 4298804 | 973 | 4.T.-;78.A.G | 1.477 | 0.725 |
| 12125860 | 974 | 2.A.-;76.G.-;78.A.C | 1.476 | 0.787 |
| 2675530 | 975 | 0.T.-;2.A.C;90.T.- | 1.474 | 1.266 |
| 7242260 | 976 | 27.-.C;88.G.- | 1.473 | 1.439 |
| 4287312 | 977 | 4.T.-;82.AA.-T | 1.473 | 0.577 |
| 3339492 | 978 | 2.A.G;0.T.-;73.AT.-C | 1.472 | 1.445 |
| 4290113 | 979 | 4.T.-;80.A.- | 1.470 | 0.639 |
| 2293835 | 980 | 0.T.-;78.A.-;80.A.- | 1.469 | 0.867 |
| 6455860 | 981 | 16.-.C;74.-.C | 1.468 | 0.527 |
| 2706303 | 982 | 0.T.-;2.C;82.AA.---;85.T.C | 1.467 | 1.023 |
| 7252350 | 983 | 27.-.C;76.-.T | 1.467 | 1.180 |
| 3277392 | 984 | 0.T.-;2.A.G;85.TC.-A | 1.467 | 1.201 |
| 8538161 | 985 | 75.-.G;132.G.C | 1.467 | 0.428 |
| 8202442 | 986 | 87.-.A | 1.465 | 0.819 |
| 2898633 | 987 | 1.-.C;78.-.C | 1.464 | 0.456 |
| 2648767 | 988 | 2.A.C;0.T.-;73.-.A | 1.463 | 0.659 |
| 6115163 | 989 | 14.-.A;88.G.- | 1.463 | 0.529 |
| 10576534 | 990 | 15.-.T;55.-.T | 1.461 | 0.556 |
| 1904556 | 991 | 0.TTA.---;3.C.A;76.GG.-C | 1.461 | 1.089 |
| 8073267 | 992 | 74.-.C | 1.459 | 0.430 |
| 8755280 | 993 | 55.-.T | 1.458 | 0.638 |
| 2341059 | 994 | 0.T.-;28.-.C | 1.457 | 1.284 |
| 3007006 | 995 | 1.TA.---;90.T.- | 1.456 | 1.125 |
| 7833962 | 996 | 55.-.G;87.-.G | 1.456 | 0.883 |
| 4299868 | 997 | 4.T.-,78.-.T | 1.456 | 0.940 |
| 8342692 | 998 | 89.A.G | 1.455 | 0.975 |
| 2262741 | 999 | 0.T.-;85.TC.-A | 1.451 | 0.583 |
| 1942088 | 1000 | 0.TT.---;2.A.C;86.C.- | 1.450 | 1.216 |
| 10200245 | 1001 | 18.-.G;74.-.T | 1.448 | 0.938 |
| 4219211 | 1002 | 4.T.-;72.-.A | 1.447 | 0.549 |
| 2457931 | 1003 | 1.TA.--;3.C.A;75.-.C | 1.444 | 0.736 |
| 3038631 | 1004 | 1.TA.---;73.AT.-G | 1.444 | 0.560 |
| 12753950 | 1005 | 0.-.T;73.A.- | 1.444 | 0.573 |
| 2129014 | 1006 | 0.TTA.---;3.C.G;75.-.G | 1.440 | 1.366 |
| 7833901 | 1007 | 55.-.G86.C.- | 1.439 | 0.671 |
| 10066878 | 1008 | 19.-.T;74.-.C | 1.439 | 0.663 |
| 2714726 | 1009 | 0.T.-;2.A.C;77.GA.---;83.A.T | 1.439 | 0.739 |
| 12106738 | 1010 | 2.A.-;72.-.C | 1.438 | 1.201 |
| 2720418 | 1011 | 0.T.-;2.A.C;77.GA.---;80.A.C | 1.436 | 1.201 |
| 2291924 | 1012 | 0.T.-;78.A.C | 1.436 | 0.937 |
| 9991025 | 1013 | 19.-.G;81.GA.-T | 1.434 | 0.688 |
| 4243954 | 1014 | 4.T.-;85.TC.-A | 1.433 | 0.674 |
| 6362816 | 1015 | 17.-.A;75.-.C | 1.433 | 0.887 |
| 8204227 | 1016 | 87.C.A | 1.432 | 1.065 |
| 1980019 | 1017 | 0.T.C;78.A.- | 1.431 | 0.702 |
| 8142815 | 1018 | 76.G.-;130.T.G | 1.429 | 0.271 |
| 10554966 | 1019 | 15.-.T;80.A.- | 1.429 | 1.003 |
| 2702620 | 1020 | 0.T.-;2.A.C;86.C.T | 1.427 | 0.892 |
| 8142856 | 1021 | 76.G.-;132.G.C | 1.427 | 0.238 |
| 12012995 | 1022 | 2.A.-.16.-.C | 1.425 | 0.515 |
| 4284095 | 1023 | 4.T.-;82.AA.-C | 1.424 | 0.718 |
| 10546168 | 1024 | 15.-.T;88.-.T | 1.424 | 1.002 |
| 8128579 | 1025 | 75.-.C | 1.424 | 0.273 |
| 2703946 | 1026 | 2.A.C.;0.T.-;82.A.-.85.T.G | 1.423 | 1.276 |
| 12433040 | 1027 | 1.TAC.---;76.G.- | 1.423 | 0.852 |
| 12162901 | 1028 | 2.A.-;89.-.C | 1.422 | 0.831 |
| 2814556 | 1029 | 0.T.-;2.A.C;19.-.G | 1.420 | 0.572 |
| 8142933 | 1030 | 76.G.-132.G.T | 1.420 | 0.297 |
| 2710592 | 1031 | 2.A.C;0.T.-;81.-.G | 1.420 | 0.684 |
| 8537382 | 1032 | 75.-.G;121.C.A | 1.419 | 0.408 |
| 12434064 | 1033 | 1.TAC.---;86.-.C | 1.417 | 0.739 |
| 12438652 | 1034 | 1.TAC.---;75.C.- | 1.417 | 0.894 |
| 8105679 | 1035 | 76.GG.-A | 1.416 | 0.238 |
| 8089861 | 1036 | 75.-.A;86.-.C | 1.414 | 0.397 |

TABLE 4-continued

Median Enrichment of DME Scaffold Variants

| index | SEQ ID NO | muts_1indexed | MI | 95% CI |
|---|---|---|---|---|
| 10177945 | 1037 | 18.-.G;72.-.A | 1.414 | 0.836 |
| 4243445 | 1038 | 4.T.-;81.GA.-C | 1.413 | 0.887 |
| 8123491 | 1039 | 75.-.C;88.G.- | 1.412 | 0.441 |
| 4313666 | 1040 | 4.T.-;70.-.T | 1.411 | 0.506 |
| 7180551 | 1041 | 27.-.A;76.-.A | 1.410 | 1.181 |
| 6534510 | 1042 | 17.-.G;76.GG.-T | 1.407 | 0.941 |
| 3025550 | 1043 | 1.TA.--;82.AA.-T | 1.407 | 0.570 |
| 10275000 | 1044 | 17.-.T;71.-.C | 1.406 | 0.754 |
| 8530347 | 1045 | 75.-C.GA | 1.406 | 0.333 |
| 12438782 | 1046 | 1.TAC.---;74.-.T | 1.404 | 0.868 |
| 2724111 | 1047 | 2.A.C;0.T.-;78.A.-;80.A.- | 1.403 | 1.013 |
| 12682492 | 1048 | 0.-.T;27.-.C | 1.402 | 1.266 |
| 8336449 | 1049 | 89.-.C | 1.400 | 0.251 |
| 2994450 | 1050 | 1.TA.--;74.-.C | 1.399 | 0.436 |
| 10070026 | 1051 | 19.-.T;76.G.- | 1.399 | 0.599 |
| 4246898 | 1052 | 4.T.-;86.CC.-A | 1.398 | 0.996 |
| 2056199 | 1053 | 0.TT.--;2.A.G;82.AA.-T | 1.398 | 1.059 |
| 2726405 | 1054 | 0.T.-;2.A.C;77.G.T | 1.398 | 0.989 |
| 8093322 | 1055 | 75.-.A | 1.396 | 0.309 |
| 4239175 | 1056 | 4.T.-;77.-.C | 1.396 | 0.979 |
| 3031832 | 1057 | 1.TA.--;78.-.T | 1.395 | 0.529 |
| 2303944 | 1058 | 0.T.-;73.A.- | 1.395 | 0.686 |
| 2255406 | 1059 | 0.T.-;76.GG.-- | 1.395 | 1.055 |
| 2468522 | 1060 | 1.TA.--;3.C.A;74.-.T | 1.394 | 0.748 |
| 8543995 | 1061 | 75.-.G;86.C.- | 1.393 | 0.372 |
| 8348831 | 1062 | 88.-.T | 1.392 | 0.333 |
| 2899043 | 1063 | 1.-.C;78.A.- | 1.392 | 0.693 |
| 6611143 | 1064 | 18.C.-;75.-.A | 1.392 | 0.602 |
| 8142880 | 1065 | 76.G.- | 1.391 | 0.256 |
| 4294538 | 1066 | 4.T.-;78.A.C | 1.390 | 0.607 |
| 447196 | 1067 | -27.C.A;75.-.G | 1.390 | 0.365 |
| 3338210 | 1068 | 2.A.G;0.T.-;75.CG.-T | 1.390 | 0.686 |
| 8538250 | 1069 | 75.-.G;131.A.C | 1.389 | 0.442 |
| 10302419 | 1070 | 17.-.T;83.-.C | 1.388 | 1.345 |
| 3169133 | 1071 | 0.T.-;2.A.G;16.-.C | 1.388 | 0.627 |
| 1855234 | 1072 | 0.TT.--;86.-.C | 1.387 | 0.590 |
| 3027053 | 1073 | 1.TA.--;80.A.- | 1.386 | 0.444 |
| 8142905 | 1074 | 76.G.-;133.A.C | 1.386 | 0.312 |
| 2465375 | 1075 | 1.TA.--;3.C.A;81.GA.-T | 1.386 | 0.850 |
| 8137397 | 1076 | 76.G.-;98.-.A | 1.385 | 0.658 |
| 3304306 | 1077 | 2.A.G;0.T.-;89.A.- | 1.384 | 1.226 |
| 8537231 | 1078 | 75.-.G;120.C.A | 1.383 | 0.451 |
| 4299393 | 1079 | 4.T.-;78.AG.-T | 1.382 | 1.034 |
| 3295454 | 1080 | 2.A.G;0.T.-;99.-.G | 1.382 | 1.039 |
| 3264318 | 1081 | 76.GG.-T | 1.380 | 0.164 |
| 8519489 | 1082 | 2.A.G;0.T.-;75.-.A | 1.379 | 0.703 |
| 3266116 | 1083 | 2.A.G;0.T.-;76.GG.-A | 1.379 | 0.672 |
| 2997992 | 1084 | 1.TA.--;76.-.A | 1.378 | 0.700 |
| 2672282 | 1085 | 2.A.C;0.T.-;86.CC.-A | 1.376 | 0.805 |
| 14798941 | 1086 | -29.A.C;75.-.C | 1.376 | 0.255 |
| 12031760 | 1087 | 2.A.-;27.G.- | 1.375 | 1.375 |
| 2201185 | 1088 | 0.T.-;16.-.C | 1.373 | 0.446 |
| 2400173 | 1089 | 1.-.A;76.G.- | 1.372 | 0.596 |
| 10088256 | 1090 | 19.-.T;76.G.-;78.A.T | 1.370 | 0.715 |
| 10284913 | 1091 | 17.-.T;77.-.A | 1.370 | 1.090 |
| 10545701 | 1092 | 15.-.T;89.A.- | 1.370 | 1.003 |
| 8212851 | 1093 | 86.-.C | 1.369 | 0.540 |
| 8132895 | 1094 | 75.-.C;86.C.- | 1.368 | 0.297 |
| 3281950 | 1095 | 2.A.G;0.T.-;86.-.C | 1.368 | 0.907 |
| 1858655 | 1096 | 0.TT.--;87.-.G | 1.368 | 0.620 |
| 12737396 | 1097 | 0.-.T;86.C.- | 1.365 | 0.552 |
| 6474033 | 1098 | 16.-.C;80.A.- | 1.363 | 0.562 |
| 2646406 | 1099 | 0.T.-;2.A.C;72.-.G | 1.363 | 1.115 |
| 3020097 | 1100 | 1.TA.--;86.-.G | 1.363 | 0.580 |
| 12160739 | 1101 | 2.A.-;91.A.-;93.A.G | 1.363 | 1.067 |
| 14919005 | 1102 | -29.A.C;2.A.-;76.G.- | 1.362 | 0.433 |
| 10527714 | 1103 | 15.-.T;79.G.- | 1.362 | 0.847 |
| 3023033 | 1104 | 1.TA.--;82.A.-;84.A.G | 1.361 | 1.195 |
| 2467773 | 1105 | 1.TA.--;3.C.A;.-.T | 1.361 | 0.680 |
| 2284824 | 1106 | 0.T.-;83.-.T | 1.361 | 0.848 |
| 9987305 | 1107 | 19.-.G;87.-.G | 1.360 | 0.734 |
| 2628450 | 1108 | 2.A.G;0.T.-;65.GC.-A | 1.360 | 0.861 |
| 8531228 | 1109 | 75.-.G;87.-.A | 1.360 | 0.691 |
| 1939243 | 1110 | 0.TT.--;2.A.C;86.-.C | 1.358 | 0.943 |
| 3050495 | 1111 | 1.TA.--;55.-.T | 1.358 | 0.880 |
| 7835450 | 1112 | 55.-.G;78.A.- | 1.358 | 0.698 |
| 12702721 | 1113 | 0.-.T;55.-.G | 1.357 | 0.531 |
| 4231994 | 1114 | 4.T.-;76.-.A | 1.357 | 0.799 |
| 10185683 | 1115 | 18.-.G;88.G.- | 1.357 | 1.038 |
| 2709497 | 1116 | 2.A.C;0.T.-;82.A.C | 1.356 | 1.204 |
| 8330844 | 1117 | 91.A.G | 1.355 | 1.033 |
| 10287644 | 1118 | 17.-.T;85.TC.-G | 1.355 | 1.182 |
| 9976346 | 1119 | 19.-.G;77.-.A | 1.355 | 0.744 |
| 8759277 | 1120 | 55.-.T;75.-.G | 1.353 | 0.800 |
| 2711676 | 1121 | 2.A.C;0.T.-;82.AA.-G | 1.352 | 0.772 |
| 10199887 | 1122 | 18.-.G;75.C.- | 1.351 | 0.818 |
| 12131652 | 1123 | 2.A.-;85.TC.-G | 1.351 | 1.139 |
| 8628479 | 1124 | 66.CT.-G;76.G.- | 1.351 | 0.362 |
| 2459762 | 1125 | 1.T.A.--;3.C.A;87.-.A | 1.350 | 1.009 |
| 8647329 | 1126 | 66.C.T | 1.350 | 1.188 |
| 6526262 | 1127 | 17.-.G;76.G.- | 1.350 | 1.265 |
| 2279498 | 1128 | 0.T.-;88.-.T | 1.350 | 0.488 |
| 2719218 | 1129 | 0.T.-;2.A.C;79.GAGAAA.TTTCTC | 1.349 | 1.087 |
| 1858516 | 1130 | 0.TT.--;86.C.- | 1.349 | 1.337 |
| 14798574 | 1131 | -29.A.C;76.GG.-C | 1..347 | 0.500 |
| 10178596 | 1132 | 18.-.G;72.-.C | 1.346 | 0.766 |
| 8118222 | 1133 | 76.GG.-C;132.G.C | 1.346 | 0.517 |
| 12181387 | 1134 | 2.A.-;82.-.T | 1.345 | 0.639 |
| 10285141 | 1135 | 17.-.T;76.G.-78.A.C | 1.345 | 0.980 |
| 8565359 | 1136 | 75.CG.-T | 1.345 | 0.288 |
| 8142963 | 1137 | 76.G.-;131.A.C | 1.344 | 0.259 |
| 6313836 | 1138 | 16.-.A;78.A.- | 1.342 | 0.715 |
| 6455586 | 1139 | 16.-.C;74.T.- | 1.341 | 0.589 |
| 10069022 | 1140 | 19.-.T;76.GG.-C | 1.339 | 0.689 |
| 8538125 | 1141 | 75.-.G130.T.G | 1.339 | 0.405 |
| 8208034 | 1142 | 88.G.- | 1.339 | 0.227 |
| 4210228 | 1143 | 4.T.-;65.G.- | 1.338 | 0.726 |
| 8555144 | 1144 | 74.-.T;86.-.C | 1.336 | 0.495 |
| 2211631 | 1145 | 0.T.-;27.G.- | 1.336 | 1.023 |
| 14799468 | 1146 | -29.A.C;76.G.- | 1.335 | 0.265 |
| 3023524 | 1147 | 1.TA.--;82.AA.-- | 1.335 | 0.777 |
| 14921453 | 1148 | -29.A.C;2.A.-;75.-.G | 1.334 | 0.448 |
| 2465666 | 1149 | 1.TA.--;3.C.A;80.A.- | 1.334 | 1.225 |
| 2124272 | 1150 | 0.TTA.---;3.C.G;86.-.C | 1.333 | 1.021 |
| 4366553 | 1151 | 4.T.-;28.-.C | 1.333 | 1.147 |
| 15160651 | 1152 | -29.A.G;75.-.C | 1.333 | 0.280 |
| 2248937 | 1153 | 0.T.-;70.T.-;73.A.C | 1.329 | 1.289 |
| 10307622 | 1154 | 17.-.T;78.A.C | 1.329 | 0.893 |
| 2670634 | 1155 | 0.T.-;2.A.C;85.TC.-- | 1.327 | 0.861 |
| 10180147 | 1156 | 18.-.G;74.-.C | 1.326 | 0.933 |
| 10288203 | 1157 | 17.-.T;87.-.A | 1.325 | 0.741 |
| 14806896 | 1158 | -29.A.C;87.-.G | 1.324 | 0.256 |
| 2708627 | 1159 | 0.T.-;2.A.C;82.AA.-- | 1.323 | 0.576 |
| 3260655 | 1160 | 2.A.G;0.T.-;74.T.- | 1.322 | 0.641 |
| 12719454 | 1161 | 0.-.T;76.GG.-A | 1.322 | 0.483 |
| 12432022 | 1162 | 1.TAC.---;74.-.C | 1.321 | 0.647 |
| 4245523 | 1163 | 4.T.-;85.TC.-G | 1.321 | 1.255 |
| 8363261 | 1164 | 87.-.T | 1.321 | 0.482 |
| 2128723 | 1165 | 0.TTA.---;3.C.G;76.GG.-T | 1.318 | 1.199 |
| 8514493 | 1166 | 77.-.T | 1.318 | 0.804 |
| 3330625 | 1167 | 0.T.-;2.A.G;77.-.T | 1.317 | 1.252 |
| 10279842 | 1168 | 17.-.T;74.-.G | 1.316 | 0.997 |
| 3271300 | 1169 | 2.A.G;0.T.-;76.G.- | 1.315 | 0.602 |
| 12209957 | 1170 | 2.A.-;73.-.G | 1.314 | 1.123 |
| 2295677 | 1171 | 0.T.-;76.G.-;78.A.T | 1.314 | 0.644 |
| 7188615 | 1172 | 27.-.A;79.GAGAAA.TTTCTC | 1.312 | 1.251 |
| 8638657 | 1173 | 66.CT.-G;78.A.- | 1.311 | 0.331 |
| 6470437 | 1174 | 16.-.C86.-.G | 1.310 | 0.430 |
| 12102732 | 1175 | 2.A.-;72.-.A | 1.307 | 0.918 |
| 8142718 | 1176 | 76.G.-;129.C.A | 1.305 | 0.257 |
| 8156448 | 1177 | 77.-.C | 1.304 | 0.590 |
| 1852995 | 1178 | 0.TT.--;75.-.C | 1.303 | 0.901 |
| 2887175 | 1179 | 1.-.C;88.G.- | 1.303 | 0.598 |
| 2263396 | 1180 | 0.T.-85.T.- | 1.302 | 1.134 |
| 1825818 | 1181 | 0.TT.-A;76.G.- | 1.302 | 1.110 |
| 8344169 | 1182 | 89.A.- | 1.302 | 1.226 |
| 2709285 | 1183 | 2.A.C;0.T.-;82.-.C | 1.301 | 0.894 |
| 3023675 | 1184 | 1.TA.--;82.A.-;84.A.T | 1.300 | 0.818 |

TABLE 4-continued

Median Enrichment of DME Scaffold Variants

| index | SEQ ID NO | muts_lindexed | MI | 95% CI |
|---|---|---|---|---|
| 10084841 | 1185 | 19.-.T;81.GA.-T | 1.298 | 0.600 |
| 1976248 | 1186 | 0.T.C;86.-.C | 1.298 | 0.826 |
| 12154344 | 1187 | 2.A.-;99.-.G | 1.296 | 1.001 |
| 13097626 | 1188 | -1.GT.--;76.G.- | 1.295 | 0.442 |
| 6458438 | 1189 | 16.-.C;76.-.A | 1.295 | 0.847 |
| 8150274 | 1190 | 77.-..A | 1.294 | 0.229 |
| 8757116 | 1191 | 55.-.T;87.-.G | 1.293 | 0.601 |
| 2701481 | 1192 | 0.T.-;2.A.C;87.C.T | 1.292 | 0.555 |
| 6458094 | 1193 | 16.-.C;76.GG.-A | 1.290 | 1.072 |
| 8096141 | 1194 | 75.-.A;87.-.G | 1.289 | 0.400 |
| 1937383 | 1195 | 0.TT.--;2.A.C;76.GG.-C | 1.288 | 1.058 |
| 10527226 | 1196 | 15.-.T;76.G.-;78.A.C | 1.288 | 0.941 |
| 2461285 | 1197 | 1.TA.--;.3.C.A | 1.288 | 1.104 |
| 9999142 | 1198 | 19.-.G;73.A.- | 1.286 | 0.905 |
| 8190839 | 1199 | 85.TC.-- | 1.286 | 0.969 |
| 4021093 | 1200 | 3.-.C;87.-.G | 1.285 | 0.949 |
| 8128562 | 1201 | 75.-.C;132.G.C | 1.284 | 0.296 |
| 4026117 | 1202 | 3.-.C;76.GG.-T | 1.282 | 0.871 |
| 3458694 | 1203 | 0.TTAC.----;75.-.C | 1.282 | 1.236 |
| 2402393 | 1204 | 1.-.A;87.-.A | 1.282 | 0.828 |
| 1852100 | 1205 | 0.TT.--;75.-.A | 1.281 | 0.682 |
| 3325688 | 1206 | 2.A.G;0.T.-;78.A.- | 1.281 | 0.892 |
| 2742029 | 1207 | 0.T.-2.A.C;73.A.T | 1.281 | 0.548 |
| 6577492 | 1208 | 18.-.A;86.-.C | 1.280 | 0.718 |
| 12218636 | 1209 | 2.A.-;66.CT.-G | 1.279 | 0.773 |
| 8219007 | 1210 | 89.-..A | 1.279 | 1.111 |
| 6369323 | 1211 | 17.-.A;76.GG.-T | 1.278 | 0.804 |
| 2651674 | 1212 | 0.T.-;2.A.C;74.TC.-- | 1.278 | 1.277 |
| 12717259 | 1213 | 0.-.T;74.-.C | 1.277 | 0.541 |
| 15160113 | 1214 | -29.A.G;76.GG.-A | 1.277 | 0.270 |
| 2900998 | 1215 | 1.-.C;76.-.T | 1.777 | 0.460 |
| 1864123 | 1216 | 0.TT.--;74.-.T | 1.275 | 0.783 |
| 1936243 | 1217 | 0.TT.--;2.A.C;73.-.A | 1.269 | 0.978 |
| 10087310 | 1218 | 19.-.T;76.-.G | 1.269 | 1.013 |
| 8128641 | 1219 | 131.A.C;75.-.C | 1.268 | 0.347 |
| 2466267 | 1220 | 1.TA.--;.3.C.A;78.-.C | 1.268 | 0.761 |
| 14814370 | 1221 | -29.A.C;74.-.T | 1.268 | 0.225 |
| 8367586 | 1222 | 86.-.G | 1.268 | 0.167 |
| 14814654 | 1223 | -29.A.C;75.CG.-T | 1.267 | 0.300 |
| 7178892 | 1224 | 27.-.A;72.-.C | 1.267 | 1.242 |
| 2713900 | 1225 | 0.T.-;2.A.C;82.AA.--;84.A.T | 1.267 | 1.065 |
| 12745658 | 1226 | 0.-.T;78.A.- | 1.266 | 0.629 |
| 12436108 | 1227 | 1.TAC.---;86.C.- | 1.265 | 0.683 |
| 8490474 | 1228 | 76.-.G;131.A.C | 1.265 | 0.316 |
| 6479094 | 1229 | 16.-.C;75.CG.-T | 1.264 | 0.658 |
| 10280354 | 1230 | 17.-.T;75.-.A | 1.264 | 1.255 |
| 10528666 | 1231 | 15.-.T;77.GA.-- | 1.264 | 1.070 |
| 10303386 | 1232 | 17.-.T;82.AA.-- | 1.264 | 1.142 |
| 2355406 | 1233 | 0.T.-;15.-.T | 1.262 | 0.700 |
| 3032160 | 1234 | 1.TA.--;78.A.T | 1.262 | 0.662 |
| 7237755 | 1235 | 27.-.C;72.-.C | 1.262 | 1.185 |
| 2295261 | 1236 | 0.T.-;78.A.T | 1.262 | 0.620 |
| 14798078 | 1237 | -29.A.C;76.GG.-A | 1.261 | 0.215 |
| 3307911 | 1238 | 0.T.-;2.A.G;86.-.G | 1.259 | 0.787 |
| 8132962 | 1239 | 75.-.C;87.-.G | 1.259 | 0.464 |
| 10181383 | 1240 | 18.-.G;75.CG.-A | 1.258 | 0.523 |
| 8197001 | 1241 | 86.-..A | 1.257 | 0.487 |
| 10309927 | 1242 | 17.-.T;76.G.-;78.A.T | 1.257 | 0.745 |
| 2301271 | 1243 | 0.T.-;73.AT.-C | 1.256 | 0.811 |
| 13853791 | 1244 | -14.A.C;75.-.G | 1.255 | 0.426 |
| 8538003 | 1245 | 75.-.G;128.T.G | 1.255 | 0.362 |
| 8531397 | 1246 | 75.-.G;88.G.- | 1.254 | 0.477 |
| 10088571 | 1247 | 19.-.T;76.GG.-T | 1.254 | 0.431 |
| 10090672 | 1248 | 19.-.T;74.-.T | 1.254 | 0.833 |
| 9978638 | 1249 | 19.-.G;87.-.A | 1.254 | 0.821 |
| 10183679 | 1250 | 18.-.G;76.G.-;78.A.C | 1.253 | 0.445 |
| 2283016 | 1251 | 0.T.-82.A.- | 1.253 | 0.466 |
| 2695201 | 1252 | 0.T.-;2.A.C;91.A.G | 1.253 | 0.804 |
| 6475853 | 1253 | 16.-.C;76.-.G | 1.251 | 0.663 |
| 6111106 | 1254 | 14.-.A;76.GG.-A | 1.250 | 0.738 |
| 3082312 | 1255 | 1.TA.--;17.-.T | 1.249 | 0.812 |
| 10566255 | 1256 | 15.-.T;73.AT.-C | 1.249 | 0.813 |
| 10070730 | 1257 | 19.-.T;79.G.- | 1.249 | 0.602 |
| 14812876 | 1258 | -29.A.C;76.GG.-T | 1.248 | 0.151 |
| 1246999 | 1259 | -15.T.G;76.G.- | 1.247 | 0.225 |
| 8558498 | 1260 | 74.-.T;132.G.C | 1.246 | 0.249 |
| 10518792 | 1261 | 15.-.T;72.-.G | 1.246 | 0.489 |
| 4277925 | 1262 | 4.T.-;84.AT.-- | 1.246 | 0.937 |
| 8352817 | 1263 | 86.C.- | 1.245 | 0.151 |
| 8538048 | 1264 | 75.-.G;129.C.A | 1.244 | 0.412 |
| 14797557 | 1265 | -29.A.C;75.-.A | 1.243 | 0.320 |
| 8538200 | 1266 | 75.-.G;133.A.C | 1.242 | 0.440 |
| 4283490 | 1267 | 4.T.-;82.-.C | 1.242 | 0.687 |
| 1865218 | 1268 | 0.TT.--;73.A.- | 1.241 | 0.704 |
| 6525015 | 1269 | 17.-.G;75.-.A | 1.241 | 0.979 |
| 10181717 | 1270 | 18.-.G;76.GG.-A | 1.240 | 1.138 |
| 6458686 | 1271 | 16.-.C;76.GG.-C | 1.240 | 0.874 |
| 9978404 | 1272 | 19.-.G;86.-.A | 1.239 | 0.802 |
| 9631659 | 1273 | 16.------------.CTCATTACTTTG | 1.238 | 1.158 |
| 1938525 | 1274 | 0.TT.--;2.A.C;77.GA.-- | 1.235 | 0.873 |
| 1907202 | 1275 | 0.TTA.--;3.C.A;87.-.G | 1.235 | 0.900 |
| 2315524 | 1276 | 0.T.-;55.-.T | 1.734 | 0.655 |
| 8531688 | 1277 | 75.-.G;89.-.A | 1.234 | 0.685 |
| 14798316 | 1278 | -29.A.C;76.-.A | 1.233 | 0.885 |
| 8590491 | 1279 | 73.A.G | 1.233 | 0.307 |
| 3335980 | 1280 | 2.A.G;0.T.-;75.C.- | 1.731 | 0.616 |
| 2695420 | 1281 | 0.T.-;2.A.C;91.AA.-G | 1.231 | 1.033 |
| 3307298 | 1282 | 0.T.-;2.A.G;87.-..T | 1.231 | 0.519 |
| 2560220 | 1283 | 0.T.-2.A.C;14.-.A | 1.231 | 0.622 |
| 15165185 | 1284 | -29.A.G;87.-.G | 1.231 | 0.270 |
| 12718005 | 1285 | 0.-.T;74.-.G | 1.731 | 0.871 |
| 10058333 | 1286 | 19.-.T;55.-.G | 1.230 | 1.084 |
| 8532180 | 1287 | 75.-.G;98.-.A | 1.229 | 0.749 |
| 7242912 | 1288 | 27.-.C;90.-.G | 1.229 | 0.949 |
| 8105731 | 1289 | 76.GG.-A;131.A.C | 1.228 | 0.230 |
| 2748293 | 1290 | 2.A.C;0.T.-;66.C.- | 1.228 | 0.985 |
| 3026215 | 1291 | 1.TA.--;77.GA.--;83.A.T | 1.227 | 0.998 |
| 1938157 | 1292 | 0.TT.--;2.A.C;77.-.A | 1.226 | 0.831 |
| 11775381 | 1293 | 2.-.C;76.G.- | 1.225 | 0.596 |
| 15161003 | 1294 | -29.A.G;76.G.- | 1.224 | 0.295 |
| 14811016 | 1295 | -29.A.C;78.-.C | 1.223 | 0.273 |
| 7237431 | 1296 | 27.-.C;72.-.A | 1.222 | 1.143 |
| 4220887 | 1297 | 4.T.-;72.-.C | 1.220 | 0.666 |
| 10561000 | 1298 | 15.-.T;76.G.-;78.A.T | 1.219 | 0.648 |
| 3318946 | 1299 | 0.T.-;2.G;81.GA.-T | 1.218 | 0.705 |
| 10565555 | 1300 | 15.-.T;75.CG.-T | 1.218 | 1.207 |
| 2644619 | 1301 | 2.A.C;0.T.-;72.-.C | 1.218 | 0.643 |
| 12112275 | 1302 | 2.A.-74.T.G | 1.217 | 0.653 |
| 1862409 | 1303 | 0.TT.--;76.-.G | 1.217 | 0.889 |
| 7189944 | 1304 | 27.-.A;78.-.T | 1.216 | 1.075 |
| 6126842 | 1305 | 14.-.A;78.-.C | 1.216 | 0.768 |
| 8543659 | 1306 | 75.-.G;88.-.G | 1.215 | 0.655 |
| 2684568 | 1307 | 2.A.C;0.T.- | 1.213 | 0.265 |
| 2697264 | 1308 | 2.A.C;0.T.-;89.A.G | 1.213 | 1.022 |
| 4285424 | 1309 | 4.T.-;82.A.G | 1.211 | 1.094 |
| 4298510 | 1310 | 4.T.-;78.A.-;80.A.- | 1.209 | 0.668 |
| 3594929 | 1311 | 2.-.A;87.-.T | 1.209 | 0.739 |
| 10310746 | 1312 | 17.-.T;76.-.T | 1.209 | 0.919 |
| 6535421 | 1313 | 17.-.G;74.-.T | 1.208 | 0.927 |
| 2738172 | 1314 | 0.T.-;2.A.C;73.-.G | 1.208 | 1.035 |
| 1942201 | 1315 | 0.TT.--;2AC;87.-.G | 1.208 | 0.973 |
| 8518877 | 1316 | 76.GG.-T;121.C.A | 1.207 | 0.182 |
| 15159780 | 1317 | -29.A.G;75.-.A | 1.206 | 0.316 |
| 2290805 | 1318 | 0.T.-;79.GAGAA.A.TTTCTC | 1.204 | 0.869 |
| 2399086 | 1319 | 1.-.A;76.GG.-A | 1.204 | 0.484 |
| 1974829 | 1320 | 0.T.C;76.GG.-A | 1.204 | 0.421 |
| 1192019 | 1321 | -15.T.G;0.T.-;2.A.C | 1.204 | 0.303 |
| 8565342 | 1322 | 75.CG.-T;132.G.C | 1.202 | 0.287 |
| 8357813 | 1323 | 87.-.G;132.G.C | 1.202 | 0.284 |
| 14647197 | 1324 | -29.A.C;0.T.-;2.A.C;75.-.G | 1.200 | 0.596 |
| 10192426 | 1325 | 18.-.G;86.C.- | 1.198 | 0.846 |
| 2239077 | 1326 | 0.T.-;65.GC.-A | 1.197 | 0.828 |
| 12185807 | 1327 | 2.A.-;80.A.-;82.A.- | 1.196 | 1.148 |
| 14921338 | 1328 | -29.A.C;2.A.-76.GG.-T | 1.195 | 0.591 |
| 1909484 | 1329 | 0.TTA.---;3.C.A;74.-.T | 1.195 | 0.900 |
| 10067367 | 1330 | 19.-.T;74.-.G | 1.194 | 0.704 |
| 8406855 | 1331 | 82.A.-84.A.T | 1.194 | 0.570 |
| 3084704 | 1332 | 1.TA.--;15.-.T | 1.194 | 0.639 |
| 8117630 | 1333 | 76.GG.-C;121.C.A | 1.194 | 0.494 |

TABLE 4-continued

Median Enrichment of DME Scaffold Variants

| index | SEQ ID NO | muts_lindexed | MI | 95% CI |
|---|---|---|---|---|
| 14813162 | 1334 | -29.A.C;76.-.T | 1.194 | 0.312 |
| 10086912 | 1335 | 19.-.T;78.A.- | 1.194 | 0.527 |
| 8565389 | 1336 | 75.CG.-T;132.G.T | 1.193 | 0.299 |
| 6627225 | 1337 | 18.C.-;76.GG.-T | 1.192 | 0.551 |
| 8485326 | 1338 | 76.-.G;86.-.C | 1.192 | 0.494 |
| 1853928 | 1339 | 0.TT.--;79.G.- | 1.192 | 0.949 |
| 12437875 | 1340 | 1.TAC.---;76.-.G | 1.192 | 0.823 |
| 10182569 | 1341 | 18.-.G;75.-.C | 1.192 | 0.877 |
| 6584325 | 1342 | 18.-.A;76.-.G | 1.191 | 0.956 |
| 8638758 | 1343 | 66.CT.-G;76.-.G | 1.190 | 0.454 |
| 6460324 | 1344 | 16.-.C;79.G.- | 1.190 | 0.494 |
| 8365015 | 1345 | 87.C.T | 1.190 | 0.873 |
| 8490408 | 1346 | 76.-.G | 1.190 | 0.320 |
| 6525955 | 1347 | 17.-.G;75.-.C | 1.188 | 1.100 |
| 6460105 | 1348 | 16.-.C;76.G.-;78.A.C | 1.188 | 0.685 |
| 6112043 | 1349 | 14.-.A;75.-.C | 1.188 | 0.773 |
| 1978266 | 1350 | 0.T.C;86.C.- | 1.186 | 0.483 |
| 8636881 | 1351 | 66.CT.-G;87.-.G | 1.186 | 0.214 |
| 15241255 | 1352 | -29.A.G;2.A.-;75.-.G | 1.186 | 0.444 |
| 6362433 | 1353 | 17.-.A.76.GG.-A | 1.186 | 0.851 |
| 2059902 | 1354 | 0.TT.--;2.A.G;74.-.T | 1.186 | 1.169 |
| 14799744 | 1355 | -29.A.C;77.-.A | 1.186 | 0.192 |
| 8118273 | 1356 | 76.GG.-C;132.G.T | 1.185 | 0.630 |
| 4278865 | 1357 | 4.T.-;84.-.T | 1.184 | 1.108 |
| 10065094 | 1358 | 19.-.T;72.-.C | 1.183 | 0.675 |
| 8561350 | 1359 | 74.-.T;87.-.G | 1.182 | 0.393 |
| 15160423 | 1360 | -29.A.G;76.GG.-C | 1.181 | 0.556 |
| 2994738 | 1361 | 1.TA.--;74.T.G | 1.181 | 0.980 |
| 15058565 | 1362 | -29.A.G;0.T.-;2.A.C | 1.180 | 0.270 |
| 12222182 | 1363 | 2.A.-;65.GC.-T | 1.180 | 0.796 |
| 2881480 | 1364 | 1.-.C;74.T.- | 1.180 | 0.538 |
| 10193035 | 1365 | 18.-.G;86.-.G | 1.178 | 0.685 |
| 6459089 | 1366 | 16.-.C;75.-.C | 1.178 | 0.589 |
| 10298749 | 1367 | 17.-.T.89.-.C | 1.178 | 0.684 |
| 8490381 | 1368 | 76.-.G;132.G.C | 1.177 | 0.336 |
| 12106660 | 1369 | 2.A.-18.-.G | 1.177 | 0.435 |
| 8124036 | 1370 | 75.-.C;98.-.A | 1.177 | 0.499 |
| 2893687 | 1371 | 1.-.C;88.-.T | 1.175 | 0.780 |
| 6305247 | 1372 | 16.-.A;77.GA.-- | 1.174 | 0.634 |
| 7248579 | 1373 | 27.-.C;83.-.T | 1.174 | 1.084 |
| 2883890 | 1374 | 1.-.C;75.-.C | 1.173 | 0.614 |
| 10183041 | 1375 | 18.-.G;76.G.- | 1.173 | 0.967 |
| 2696443 | 1376 | 0.T.-;2.A.C;89.A.C | 1.173 | 0.977 |
| 15239681 | 1377 | -29.A.G;2.A.-;76.G.- | 1.173 | 0.487 |
| 8087771 | 1378 | 74.-.T;87.-.G | 1.173 | 0.426 |
| 10285497 | 1379 | 17.-.T;79.G.- | 1.172 | 0.930 |
| 8118258 | 1380 | 76.GG.-C;133.A.C | 1.171 | 0.499 |
| 8141939 | 1381 | 76.G.-;121.C.A | 1.171 | 0.257 |
| 8066677 | 1382 | 74.T.- | 1.169 | 0.240 |
| 8558553 | 1383 | 74.-.T;132.G.T | 1.168 | 0.294 |
| 6469022 | 1384 | 16.-.C;89.-.C | 1.168 | 0.468 |
| 1046356 | 1385 | -17.C.A;75.-.G | 1.167 | 0.335 |
| 10532753 | 1386 | 15.-.T;89.-.A | 1.166 | 0.942 |
| 2706855 | 1387 | 2.A.C;0.T.-;83.-.G | 1.166 | 0.619 |
| 12194678 | 1388 | 2.A.-;78.A.G | 1.165 | 0.915 |
| 12126149 | 1389 | 2.A.-;77.-.C | 1.164 | 0.392 |
| 3039439 | 1390 | 1.TA.--;70.-.T | 1.163 | 1.008 |
| 8123371 | 1391 | 75.-.C;87.-.A | 1.162 | 0.505 |
| 15160286 | 1392 | -29.A.G;76.-.A | 1.162 | 0.722 |
| 8758541 | 1393 | 55.-.T;80.A.- | 1.161 | 0.587 |
| 12433294 | 1394 | 1.TAC.---;79.G.- | 1.161 | 0.560 |
| 14801714 | 1395 | -29.A.C;87.-.A | 1.160 | 0.841 |
| 15058156 | 1396 | 2.A.C;0.T.-;-29.A.G;76.G.- | 1.159 | 0.397 |
| 2298993 | 1397 | 0.T.-;75.C.- | 1.158 | 0.419 |
| 13100965 | 1398 | -1.GT.--;78.A.- | 1.158 | 0.371 |
| 8438445 | 1399 | 77.GA.-;83.A.T | 1.156 | 0.839 |
| 8519469 | 1400 | 76.GG.-T;132.G.C | 1.156 | 0.148 |
| 8569101 | 1401 | 75.CGG.-TT | 1.155 | 0.217 |
| 4310993 | 1402 | 4.T.-;73.AT.-C | 1.153 | 0.454 |
| 9971050 | 1403 | 19.-.G;72.-.C | 1.153 | 0.725 |
| 2996647 | 1404 | 1.TA.--;75.CG.-A | 1.152 | 0.812 |
| 8561305 | 1405 | 74.-.T;86.C.- | 1.151 | 0.238 |
| 8093224 | 1406 | 75.-.A;129.C.A | 1.151 | 0.273 |
| 3323632 | 1407 | 2.A.G;0.T.-;78.AG.-C | 1.151 | 0.849 |
| 14663326 | 1408 | -29.A.C;0.T.-;2.A.G;75.-.G | 1.150 | 0.600 |
| 1936729 | 1409 | 0.TT.--;2.A.C;74.-.G | 1.150 | 1.030 |
| 1977130 | 1410 | 0.T.C | 1.148 | 0.707 |
| 8141742 | 1411 | 120.C.A;76.G.- | 1.148 | 0.267 |
| 1908681 | 1412 | 0.TTA.---;3.C.A;76.-.G | 1.148 | 0.965 |
| 3017898 | 1413 | 1.TA.--;89.A.G | 1.148 | 0.737 |
| 3340495 | 1414 | 0.T.-;2.A.G;73.A.C | 1.148 | 1.096 |
| 2254255 | 1415 | 0.T.-;75.CG.-A | 1.147 | 0.701 |
| 11953402 | 1416 | 2.AC.--;4.T.C;76.GG.-C | 1.145 | 1.093 |
| 2684619 | 1417 | 0.T.-;2.C;132.G.T | 1.145 | 0.260 |
| 10314306 | 1418 | 17.-.T;73.AT.-C | 1.144 | 1.029 |
| 10559572 | 1419 | 15.-.T;78.A.G | 1.144 | 0.579 |
| 2630318 | 1420 | 2.A.C;0.T.-;66.CT.-A | 1.144 | 0.534 |
| 1943847 | 1421 | 0.TT.--.2.A.C;81.GA.-T | 1.143 | 0.765 |
| 4270685 | 1422 | 4.T.-;90.-.T | 1.142 | 1.061 |
| 8066737 | 1423 | 74.T.-;131.A.C | 1.142 | 0.298 |
| 6101577 | 1424 | 14.-.A;55.-.G | 1.142 | 0.632 |
| 4279604 | 1425 | 4.T.-;82.A.- | 1.141 | 0.866 |
| 2284176 | 1426 | 0.T.-;83.-.G | 1.141 | 0.574 |
| 6480468 | 1427 | 16.-.C;70.-.T | 1.140 | 0.614 |
| 2640171 | 1428 | 0.T.-;2.A.C;71.-.C | 1.137 | 0.936 |
| 10194587 | 1429 | 18.-.G;82.AA.-C | 1.137 | 0.867 |
| 15456465 | 1430 | -30.C.G;75.-.G | 1.136 | 0.421 |
| 3432602 | 1431 | 0.T.-;2.A.G;18.-.G | 1.136 | 0.359 |
| 8345831 | 1432 | 89.-.T | 1.135 | 0.634 |
| 3023247 | 1433 | 1.T.A.---83.-.T | 1.135 | 0.960 |
| 10472698 | 1434 | 16.C.-;76.-.G | 1.134 | 0.911 |
| 1855129 | 1435 | 0.TT.--.88.G- | 1.133 | 0.759 |
| 9993029 | 1436 | 19.-.G;78.A.- | 1.133 | 0.793 |
| 15168776 | 1437 | -29.A.G;76.GG.-T | 1.132 | 0.227 |
| 2464359 | 1438 | 1.TA.--;3.C.A;82.A.-;84.A.G | 1.132 | 1.057 |
| 12156161 | 1439 | 2.A.-;98.-.T | 1.131 | 0.852 |
| 8544614 | 1440 | 75.-.G;82.A.- | 1.131 | 0.458 |
| 2278784 | 1441 | 0.T.-;89.A.G | 1.130 | 0.932 |
| 4229697 | 1442 | 4.T.-;75.CG.-A | 1.129 | 1.031 |
| 6461360 | 1443 | 16.-.C;82.-.A | 1.129 | 0.609 |
| 8128601 | 1444 | 133.A.C75.-.C | 1.129 | 0.316 |
| 6362099 | 1445 | 17.-.A;74.-.G | 1.128 | 0.792 |
| 14806733 | 1446 | -29.A.C;86.C.- | 1.128 | 0.128 |
| 1937160 | 1447 | 0.TT.--;2.A.C;76.GG.-A | 1.126 | 1.000 |
| 4311644 | 1448 | 4.T.-;73.A.C | 1.126 | 0.593 |
| 1863149 | 1449 | 0.TT.--;76.GG.-T | 1.126 | 0.643 |
| 15169751 | 1450 | -29.A.G;74.-.T | 1.126 | 0.265 |
| 14811726 | 1451 | -29.A.C;76.-.G | 1.126 | 0.338 |
| 6480066 | 1452 | 16.-.C;73.AT.-G | 1.125 | 0.918 |
| 3014440 | 1453 | 1.TA.--;98.-.T | 1.125 | 0.945 |
| 6473404 | 1454 | 16.-.C;82.AA.-T | 1.125 | 0.450 |
| 7179375 | 1455 | 27.-.A;73.-.A | 1.123 | 1.119 |
| 12303885 | 1456 | 2.A.-;19.-.T | 1.123 | 0.456 |
| 2267762 | 1457 | 0.T.-;98.-.A | 1.122 | 0.679 |
| 10318319 | 1458 | 17.-.T;66.CT.-G | 1.122 | 1.050 |
| 8093357 | 1459 | 75.-.A;132.G.T | 1.121 | 0.315 |
| 3027775 | 1460 | 1.TA.--;80.AG.-T | 1.121 | 0.673 |
| 10549691 | 1461 | 15.-.T;82.A.- | 1.120 | 0.844 |
| 8558571 | 1462 | 74.-.T;131.A.C | 1.119 | 0.242 |
| 12210725 | 1463 | 2.A.-;73.AT.-G | 1.119 | 0.805 |
| 6462677 | 1464 | 16.-.C;86.-.C | 1.118 | 0.994 |
| 2281811 | 1465 | 0.T.-;86.CC.-T | 1.118 | 0.883 |
| 8496336 | 1466 | 78.A.-;80.A.- | 1.117 | 0.515 |
| 3038148 | 1467 | 1.TA.--;73.A.C | 1.117 | 0.862 |
| 10199335 | 1468 | 75.-.G;127.T.G | 1.116 | 0.444 |
| 14801930 | 1469 | -29.A.C;88.G.- | 1.115 | 0.262 |
| 2885740 | 1470 | 1.-.C;81.GA.-C | 1.115 | 0.689 |
| 8436871 | 1471 | 81.GA.-T | 1.115 | 0.274 |
| 6533591 | 1472 | 17.-.G78.-.C | 1.115 | 0.880 |
| 8508461 | 1473 | 78.A.T | 1.115 | 0.523 |
| 2303928 | 1474 | 0.T.-;70.-.T | 1.114 | 0.865 |
| 10200479 | 1475 | 18.-.G;75.CG.-T | 1.113 | 0.732 |
| 8142460 | 1476 | 76.G.-;126.C.A | 1.111 | 0.288 |
| 8490449 | 1477 | 76.-.G;132.G.T | 1.111 | 0.315 |
| 1862090 | 1478 | 0.TT.--;78.A.- | 1.111 | 0.800 |
| 8105143 | 1479 | 76.GG.-A;121.C.A | 1.111 | 0.256 |
| 10204124 | 1480 | 18.-.G;65.GC.-T | 1.110 | 0.661 |
| 2696979 | 1481 | 0.T.-;2.A.C;88.-.G | 1.110 | 0.607 |
| 1246393 | 1482 | -15.T.G;76.GG.-A | 1.110 | 0.194 |
| 4277641 | 1483 | 4.T.-;84.-.C | 1.109 | 1.085 |

TABLE 4-continued

Median Enrichment of DME Scaffold Variants

| index | SEQ ID NO | muts_1indexed | MI | 95% CI |
|---|---|---|---|---|
| 12163684 | 1484 | 2.A.-;88.-.G | 1.109 | 0.570 |
| 3643882 | 1485 | 3.CT.-A;76.GG.-A | 1.109 | 0.785 |
| 6461122 | 1486 | 16.-.C;81.GA.-C | 1.108 | 0.626 |
| 14645694 | 1487 | 2.A.C;0.T.-;-29.A.C | 1.108 | 0.268 |
| 2678659 | 1488 | 0.T.-;2.A.C;98.-.A | 1.108 | 0.376 |
| 2295085 | 1489 | 0.T.-;77.GA.--;80.A.T | 1.108 | 0.695 |
| 8127785 | 1490 | 75.-.C;120.C.A | 1.107 | 0.299 |
| 8357871 | 1491 | 87.-.G;132.G.T | 1.107 | 0.336 |
| 12090020 | 1492 | 2.A.-;66.CT.-A | 1.106 | 0.760 |
| 3079463 | 1493 | 1.TA.--;19.-.T | 1.105 | 0.424 |
| 10277558 | 1494 | 17.-.T;72.-.G | 1.105 | 0.335 |
| 2694724 | 1495 | 0.T.-;2.A.C;92.A.T | 1.102 | 0.929 |
| 3135565 | 1496 | 1.T.G;3.C.-;75.C.- | 1.102 | 0.673 |
| 6304328 | 1497 | 16.-.A;75.-.C | 1.102 | 0.655 |
| 2708067 | 1498 | 2.A.C;0.T.-;83.-.T | 1.102 | 0.859 |
| 6469331 | 1499 | 16.-.C;89.A.- | 1.101 | 0.791 |
| 10073526 | 1500 | 19.-.T;90.T.- | 1.101 | 0.917 |
| 3017595 | 1501 | 1.TA.--;89.AT.-G | 1.101 | 0.904 |
| 3031194 | 1502 | 1.TA.--;78.A.G | 1.100 | 1.042 |
| 12123777 | 1503 | 2.A.-;76.G.-;132.G.C | 1.100 | 0.426 |
| 15451300 | 1504 | -30.C.G;76.G.- | 1.100 | 0.258 |
| 8105041 | 1505 | 76.GG.-A;120.C.A | 1.100 | 0.198 |
| 2894267 | 1506 | 1.-.C;87.-.T | 1.099 | 0.722 |
| 2998547 | 1507 | 1.TA.--;76.GG.-C | 1.099 | 0.772 |
| 3022051 | 1508 | 1.TA.--;83.-.C | 1.099 | 0.800 |
| 8512487 | 1509 | 76.G.-;78.A.T | 1.098 | 0.434 |
| 2285757 | 1510 | 0.T.-;82.AA.-C | 1.098 | 0.581 |
| 6531470 | 1511 | 17.-.G;87.-.G | 1.097 | 0.892 |
| 3461447 | 1512 | 0.TTAC.----;78.A.- | 1.097 | 1.032 |
| 6475031 | 1513 | 16.-.C;78.-.C | 1.096 | 0.623 |
| 10194914 | 1514 | 18.-.G;82.AA.-G | 1.095 | 0.926 |
| 1041972 | 1515 | -17.C.A;76.G.- | 1.094 | 0.260 |
| 8537811 | 1516 | 75.-.G;126.C.A | 1.094 | 0.416 |
| 3020817 | 1517 | 1.TA.--;84.AT.-- | 1.094 | 1.006 |
| 2887379 | 1518 | 1.-.C;86.-.C | 1.093 | 0.650 |
| 1854285 | 1519 | 0.TT.--;77.GA.-- | 1.093 | 0.836 |
| 8357326 | 1520 | 87.-.G;121.C.A | 1.093 | 0.228 |
| 8128534 | 1521 | 75.-.C;130.T.G | 1.092 | 0.292 |
| 1947291 | 1522 | 0.TT.--;2.A.C;73.A.- | 1.092 | 1.083 |
| 12432721 | 1523 | 1.TAC.---;76.GG.-C | 1.091 | 0.425 |
| 1252779 | 1524 | -15.T.G;75.-.G | 1.091 | 0.436 |
| 3588353 | 1525 | 2.-.A;86.-.C | 1.090 | 0.473 |
| 2900664 | 1526 | 1.-.C;76.GG.-T | 1.090 | 0.928 |
| 8076983 | 1527 | 74.T.G | 1.090 | 0.516 |
| 2300899 | 1528 | 0.T.-;73.-.C | 1.088 | 0.922 |
| 12202788 | 1529 | 2.A.-;75.-.G;132.G.C | 1.087 | 0.397 |
| 10070325 | 1530 | 19.-.T;77.-.A | 1.085 | 0.602 |
| 14685826 | 1531 | -29.A.C;4.T.-;76.G.- | 1.085 | 0.875 |
| 14351033 | 1532 | -25.A.C;75.-.G | 1.085 | 0.402 |
| 8607376 | 1533 | 73.A.T | 1.084 | 0.466 |
| 12439360 | 1534 | 1.TAC.---;73.A.- | 1.084 | 0.785 |
| 12718596 | 1535 | 0.-.T;75.-.A | 1.083 | 0.730 |
| 2712801 | 1536 | 2.A.C;0.T.-;82.A.T | 1.083 | 1.030 |
| 6613293 | 1537 | 18.C.-;77.-.C | 1.082 | 0.704 |
| 8480766 | 1538 | 78.A.- | 1.081 | 0.244 |
| 2414074 | 1539 | 1.-.A;75.CG.-T | 1.078 | 0.690 |
| 8105662 | 1540 | 76.GG.-A;132.G.C | 1.078 | 0.266 |
| 2282078 | 1541 | 0.T.-;84.AT.-- | 1.078 | 1.018 |
| 8096091 | 1542 | 75.-.A;86.C.- | 1.078 | 0.285 |
| 442111 | 1543 | -27.C.A;76.GG.-C | 1.078 | 0.495 |
| 12161656 | 1544 | 2.A.-91.A.G | 1.076 | 0.678 |
| 9997135 | 1545 | 19.-.G;75.CG.-T | 1.076 | 0.618 |
| 6480747 | 1546 | 16.-.C;73.A.- | 1.074 | 0.613 |
| 8066659 | 1547 | 74.T.-;132.G.C | 1.074 | 0.263 |
| 4265165 | 1548 | 4.T.-;99.-.G | 1.073 | 0.742 |
| 8212888 | 1549 | 86.-.C;132.G.T | 1.072 | 0.490 |
| 10532402 | 1550 | 15.-.T;88.GA.-C | 1.071 | 0.565 |
| 2897244 | 1551 | 1.-.C;81.GA.-T | 1.071 | 0.381 |
| 2274809 | 1552 | 0.T.-;98.-.T | 1.071 | 0.702 |
| 3584484 | 1553 | 2.-.A;76.GG.-C | 1.071 | 0.859 |
| 12115802 | 1554 | 2.A.-;75.CG.-A | 1.070 | 0.736 |
| 3349186 | 1555 | 2.A.G;0.T.-;66.CT.-G | 1.070 | 0.943 |
| 3314448 | 1556 | 0.T.-;2.A.G;82.A.-;84.A.T | 1.069 | 0.670 |
| 2882882 | 1557 | 1.-.C;76.GG.-A | 1.069 | 0.641 |
| 8112365 | 1558 | 132.G.C;76.-.A | 1.068 | 0.642 |
| 8118289 | 1559 | 76.GG.-C;131.A.C | 1.068 | 0.672 |
| 2684538 | 1560 | 0.T.-;2.A.C;132.G.C | 1.068 | 0.292 |
| 3305908 | 1561 | 2.A.G;0.T.-;86.C.- | 1.067 | 0.815 |
| 12141962 | 1562 | 2.A.-;98.-.A | 1.067 | 0.769 |
| 8629287 | 1563 | 66.CT.-G;87.-.A | 1.067 | 0.521 |
| 10548927 | 1564 | 15.-.T84.-.G | 1.066 | 0.949 |
| 12437589 | 1565 | 1.TAC.---;78.-.C | 1.066 | 1.010 |
| 8494451 | 1566 | 76.-.G;87.-.G | 1.065 | 0.356 |
| 8148054 | 1567 | 76.G.-;87.-.G | 1.065 | 0.414 |
| 2684598 | 1568 | 0.T.-;2.A.C;133.A.C | 1.064 | 0.264 |
| 1806606 | 1569 | -3.TAGT.----;76.G.- | 1.063 | 0.955 |
| 6112609 | 1570 | 14.-.A;76.G.- | 1.063 | 0.690 |
| 8128619 | 1571 | 75.-.C;132.G.T | 1.063 | 0.341 |
| 2263869 | 1572 | 0.T.-;85.-.G | 1.062 | 1.017 |
| 8519538 | 1573 | 76.GG.-.T;131.A.C | 1.061 | 0.210 |
| 15167837 | 1574 | -29.A.C;78.A.- | 1.061 | 0.247 |
| 8539891 | 1575 | 113.A.C;75.-.G | 1.061 | 0.380 |
| 6110621 | 1576 | 14.-.A;75.-.A | 1.060 | 0.621 |
| 4012102 | 1577 | 3.-.C;76.GG.-A | 1.059 | 1.032 |
| 14644765 | 1578 | -29.A.C;0.T.-;2.A.C;76.GG.-A | 1.059 | 0.330 |
| 6114928 | 1579 | 14.-.A;87.-.A | 1.058 | 0.886 |
| 1858781 | 1580 | 0.TT.--;-;87.-.T | 1.058 | 0.825 |
| 10090936 | 1581 | 19.-.T;75.CG.-C | 1.056 | 0.659 |
| 2002673 | 1582 | 0.TTA.---;86.-.C | 1.055 | 0.913 |
| 1937274 | 1583 | 0.TT.--;2.A.C;76.-.A | 1.055 | 0.766 |
| 1946930 | 1584 | 2.A.C;0.TT.--;73.AT.-G | 1.054 | 1.042 |
| 8564806 | 1585 | 75.CG.-T;121.C.A | 1.054 | 0.274 |
| 14646416 | 1586 | -29.A.C;0.T.-;2.A.C;78.A.- | 1.053 | 0.595 |
| 3279449 | 1587 | 2.A.G;0.T.-;86.-.A | 1.053 | 0.589 |
| 10183929 | 1588 | 18.-.G;79.G.- | 1.052 | 0.658 |
| 4281239 | 1589 | 4.T.-;83.-.G | 1.052 | 0.864 |
| 8636987 | 1590 | 66.CT.-G;87.-.T | 1.052 | 0.463 |
| 2684414 | 1591 | 129.C.A;2.A.C;0.T.- | 1.051 | 0.312 |
| 10567800 | 1592 | 15.-.T;70.-.T | 1.050 | 0.621 |
| 12183487 | 1593 | 2.A.-;77.GA.--;83.A.T | 1.049 | 0.987 |
| 3429655 | 1594 | 0.T.-;2.A.G;19.-.T | 1.049 | 0.495 |
| 15168064 | 1595 | -29.A.C;76.-.G | 1.048 | 0.302 |
| 8579268 | 1596 | 73.A.C | 1.048 | 0.683 |
| 12725378 | 1597 | 0.-.T;86.-.A | 1.047 | 0.366 |
| 12133179 | 1598 | 2.A.-;85.TC.-- | 1.047 | 0.820 |
| 12169171 | 1599 | 2.A.-;87.C.T | 1.047 | 0.600 |
| 1974530 | 1600 | 0.T.C;74.-.G | 1.045 | 0.682 |
| 3276852 | 1601 | 2.A.G;0.T.-;81.GA.-C | 1.045 | 0.975 |
| 2277126 | 1602 | 0.T.-;91.A.-;93.A.G | 1.044 | 0.955 |
| 2668148 | 1603 | 0.T.-;2.A.C;80.-.A | 1.043 | 0.586 |
| 1946365 | 1604 | 0.TT.--;2.A.C;74.-.T | 1.043 | 1.041 |
| 10086224 | 1605 | 19.-.T;78.AG.-C | 1.043 | 0.736 |
| 6474902 | 1606 | 16.-.C;78.AG.-C | 1.042 | 0.503 |
| 3001790 | 1607 | 1.TA.--;77.-.C | 1.042 | 0.684 |
| 6463023 | 1608 | 16.-.C;89.-.A | 1.042 | 0.830 |
| 8470293 | 1609 | 78.-.C;132.G.T | 1.042 | 0.300 |
| 3134206 | 1610 | 1.T.G;3.C.- | 1.041 | 0.793 |
| 10203551 | 1611 | 18.-.G;66.CT.-G | 1.040 | 0.787 |
| 8629503 | 1612 | 66.CT.-G;86.-.C | 1.039 | 0.370 |
| 13846013 | 1613 | -14.A.C;76.G.- | 1.038 | 0.247 |
| 2263715 | 1614 | 0.T.-;85.TC.-G | 1.038 | 0.802 |
| 10560681 | 1615 | 15.-.T;78.A.T | 1.038 | 0.677 |
| 1253221 | 1616 | -15.T.G;75.CG-T | 1.038 | 0.213 |
| 10556907 | 1617 | 15.-.T;78.AG.-C | 1.037 | 1.020 |
| 3319204 | 1618 | 0.T.-2.A.G;77.GA.--;83.A.T | 1.036 | 0.978 |
| 2277677 | 1619 | 0.T.-;91.AA.-G | 1.035 | 0.945 |
| 3044972 | 1620 | 1.TA.--;65.TG.-T | 1.034 | 0.777 |
| 2728986 | 1621 | 0.T.-;2.A.C;76.GG.--;78.A.T | 1.033 | 0.961 |
| 15059527 | 1622 | -29.A.G;0.T.-2.A.C;75.-.G | 1.033 | 0.531 |
| 8127925 | 1623 | 75.-.C;121.C.A | 1.032 | 0.246 |
| 8069875 | 1624 | 74.T.-;87.-.G | 1.032 | 0.583 |
| 4210905 | 1625 | 4.T.-;66.CT.-A | 1.032 | 0.842 |
| 393375 | 1626 | -27.C.A;0.T.-2.A.C | 1.031 | 0.249 |
| 6469193 | 1627 | 16.-.C;88.-.G | 1.030 | 0.736 |
| 12723788 | 1628 | 0.-.T;77.GA.-- | 1.030 | 0.436 |
| 1975104 | 1629 | 0.T.C;75.-.C | 1.030 | 0.579 |
| 447486 | 1630 | -27.C.A;74.-.T | 1.030 | 0.222 |
| 2304326 | 1631 | 0.T.-;73.A.T | 1.029 | 0.531 |
| 8480805 | 1632 | 78.A.-;132.G.T | 1.029 | 0.245 |
| 10289207 | 1633 | 17.-.T;89.-.A | 1.026 | 0.760 |

TABLE 4-continued

Median Enrichment of DME Scaffold Variants

| index | SEQ ID NO | muts_lindexed | MI | 95% CI |
|---|---|---|---|---|
| 10541758 | 1634 | 15.-.T;99.-.G | 1.026 | 0.736 |
| 8580639 | 1635 | 73.-TC.G- | 1.026 | 0.359 |
| 2129400 | 1636 | 0.TTA.---;3.C.G;74.-.T | 1.026 | 1.011 |
| 8142671 | 1637 | 76.G.-128.T.G | 1.026 | 0.290 |
| 12726231 | 1638 | 0.-.T;88.G.- | 1.026 | 0.405 |
| 10288957 | 1639 | 17.-.T;88.GA.-C | 1.025 | 0.602 |
| 2982939 | 1640 | 1.TA.--;65.GC.-A | 1.025 | 0.854 |
| 8357852 | 1641 | 87.-.G;133.A.C | 1.024 | 0.267 |
| 6626305 | 1642 | 18.C.-;76.-.G | 1.024 | 0.941 |
| 15167605 | 1643 | -29.A.G;78.-.C | 1.024 | 0.228 |
| 3273923 | 1644 | 2.A.G;0.T.-;79.G.- | 1.022 | 0.761 |
| 10553626 | 1645 | 15.T;82.AA.-T | 1.020 | 0.844 |
| 3029129 | 1646 | 1.TA.--;78.A.C | 1.018 | 0.493 |
| 3133667 | 1647 | 1.T.G;3.C.-;76.G.- | 1.018 | 0.664 |
| 14921066 | 1648 | -29.A.C;2.A.-;78.A.- | 1.018 | 0.654 |
| 14806598 | 1649 | -29.A.C;88-T | 1.017 | 0.327 |
| 8139512 | 1650 | 115.T.G;76.G.- | 1.017 | 0.260 |
| 8636794 | 1651 | 66.CT.-G;86.C.- | 1.017 | 0.224 |
| 8127584 | 1652 | 75.-.C;119.C.A | 1.017 | 0.258 |
| 4311933 | 1653 | 4.T.-;73.-.G | 1.016 | 0.722 |
| 6471359 | 1654 | 16.-.C;83.-.C | 1.016 | 0.690 |
| 12433542 | 1655 | 1.TAC.---;77.GA.- | 1.015 | 0.963 |
| 8093303 | 1656 | 75.-.A;132.G.C | 1.014 | 0.287 |
| 1246761 | 1657 | -15.T.G;75.-.C | 1.014 | 0.245 |
| 1943763 | 1658 | 0.TT.--;2.A.C;82.AA.-T | 1.013 | 0.876 |
| 4158980 | 1659 | 4.T.-;16.-.C | 1.012 | 0.731 |
| 8470306 | 1660 | 78.-.C;131.A.C | 1.012 | 0.269 |
| 8069089 | 1661 | 74.T.-;98.-.T | 1.012 | 0.754 |
| 12438882 | 1662 | 1.TAC.---;75.CG.-T | 1.012 | 0.646 |
| 8338521 | 1663 | 89.AT.-G | 1.010 | 0.922 |
| 10088951 | 1664 | 19.-.T;76.-.T | 1.010 | 0.995 |
| 12163085 | 1665 | 2.A.-;89.A.C | 1.010 | 1.006 |
| 8479927 | 1666 | 78.A.-;121.C.A | 1.008 | 0.198 |
| 10196772 | 1667 | 18.-.G;78.A.C | 1.007 | 0.606 |
| 8552295 | 1668 | 75.C.-;87.-.G | 1.006 | 0.446 |
| 4027916 | 1669 | 3.-.C;74.-.T | 1.006 | 0.888 |
| 8489338 | 1670 | 76.-.G;119.C.A | 1.005 | 0.338 |
| 446968 | 1671 | -27.C.A;76.GG.-T | 1.005 | 0.187 |
| 2049927 | 1672 | 0.TT.--;2.A.G;88.G.- | 1.005 | 0.953 |
| 8598621 | 1673 | 70.-.T;87.-.G | 1.004 | 0.383 |
| 8600573 | 1674 | 73.A.-;86.-.C | 1.004 | 0.369 |
| 8473900 | 1675 | 78.A.C | 1.003 | 0.272 |
| 12174360 | 1676 | 2.A.-;83.-.C | 1.002 | 0.612 |
| 442458 | 1677 | -27.C.A;76.G.- | 1.001 | 0.255 |
| 15162537 | 1678 | -29.A.G;86.-.C | 1.000 | 0.512 |
| 2991036 | 1679 | 1.TA.--;72.-.C | 0.999 | 0.524 |
| 8489557 | 1680 | 76.-.G;120.C.A | 0.999 | 0.235 |
| 2704195 | 1681 | 0.T.-;2.A.C;84.A.G | 0.999 | 0.779 |
| 12746931 | 1682 | 0.-.T;78.AG.-T | 0.999 | 0.695 |
| 8544289 | 1683 | 75.-.G;86.-.G | 0.998 | 0.330 |
| 8490052 | 1684 | 76.-.G;126.C.A | 0.998 | 0.284 |
| 3003857 | 1685 | 1.TA.--;81.GA.-C | 0.997 | 0.622 |
| 2683589 | 1686 | 0.T.-;2.A.C;121.C.A | 0.997 | 0.259 |
| 8565256 | 1687 | 75.CG.-T;129.C.A | 0.996 | 0.264 |
| 2684649 | 1688 | 0.T.-;2.A.C;131.A.C | 0.995 | 0.272 |
| 10192242 | 1689 | 18.-.G;88.-.T | 0.995 | 0.989 |
| 8128468 | 1690 | 75.-.C;129.C.A | 0.995 | 0.262 |
| 3255338 | 1691 | 2.A.G;0.T.-;72.-.C | 0.994 | 0.842 |
| 7829410 | 1692 | 55.-.G;75.-.C | 0.994 | 0.860 |
| 15162331 | 1693 | -29.A.G;87.-.A | 0.993 | 0.691 |
| 8212834 | 1694 | 86.-.C;132.G.C | 0.992 | 0.467 |
| 13222300 | 1695 | 2.A.G;-3.TAGT.----;76.G.- | 0.991 | 0.723 |
| 8470255 | 1696 | 78.-.C;132.G.C | 0.991 | 0.219 |
| 2661937 | 1697 | 132.G.C;2.A.C;0.T.-;76.G.- | 0.990 | 0.390 |
| 2670761 | 1698 | 0.T.-;2.A.C;85.TCC.-- | 0.990 | 0.720 |
| 11776916 | 1699 | 2.-.C;87.-.A | 0.989 | 0.938 |
| 12747759 | 1700 | 0.-.T;77.-.T | 0.989 | 0.938 |
| 15165085 | 1701 | -29.A.G;86.C.- | 0.987 | 0.176 |
| 8212745 | 1702 | 86.-.C;129.C.A | 0.987 | 0.509 |
| 2989789 | 1703 | 1.TA.--;72.-.A | 0.986 | 0.659 |
| 6531564 | 1704 | 17.-.G;87.-.T | 0.985 | 0.962 |
| 12436169 | 1705 | 1.TAC.---;87.-.G | 0.984 | 0.678 |
| 3311127 | 1706 | 2.A.G;0.T.-;82.A.- | 0.984 | 0.759 |
| 2264270 | 1707 | 0.T.-;86.CC.-A | 0.983 | 0.775 |
| 10091719 | 1708 | 19.-.T;73.AT.-G | 0.982 | 0.402 |
| 8143233 | 1709 | 76.G.-;123.A.C | 0.982 | 0.226 |
| 1248077 | 1710 | -15.T.G;86.-.C | 0.981 | 0.619 |
| 12716866 | 1711 | 0.-.T;74.T.- | 0.981 | 0.501 |
| 3303133 | 1712 | 2.A.G;0.T.-;89.-.C | 0.980 | 0.929 |
| 9974910 | 1713 | 19.-.G;76.GG.-C | 0.980 | 0.702 |
| 8143415 | 1714 | 76.G.-;122.A.C | 0.980 | 0.247 |
| 1981670 | 1715 | 0.T.C;74.-.T | 0.980 | 0.590 |
| 2302384 | 1716 | 0.T.-;73.AT.-G | 0.978 | 0.565 |
| 1809039 | 1717 | -3.TAGT.----;78.A- | 0.978 | 0.801 |
| 13139359 | 1718 | -1.G.-;2.A.C | 0.978 | 0.275 |
| 8538659 | 1719 | 75.-.G;122.A.C | 0.978 | 0.392 |
| 2651461 | 1720 | 0.T.-;2.A.C;74.T.G | 0.977 | 0.582 |
| 3028256 | 1721 | 1.TA.--;79.GA.-T | 0.977 | 0.767 |
| 444970 | 1722 | -27.C.A;87.-.G | 0.976 | 0.225 |
| 2271218 | 1723 | 132.G.T;0.T.- | 0.976 | 0.376 |
| 13101590 | 1724 | -1.GT.--;76.-.G | 0.976 | 0.320 |
| 15169928 | 1725 | -29.A.G;75.CG.-T | 0.976 | 0.276 |
| 6454149 | 1726 | 16.-.-;72.-.C | 0.976 | 0.472 |
| 8519506 | 1727 | 76.GG.-T;133.A.C | 0.976 | 0.183 |
| 1936400 | 1728 | 0.TT.--;2.A.C;74.T.- | 0.975 | 0.971 |
| 8363289 | 1729 | 87.-.T;132.G.T | 0.975 | 0.349 |
| 14646928 | 1730 | -29.A.C;0.T.-;2.A.C;76.-.G | 0.975 | 0.273 |
| 8212907 | 1731 | 86.-.C;131.A.C | 0.975 | 0.470 |
| 13097486 | 1732 | -1.GT.--;75.-.C | 0.974 | 0.347 |
| 3272148 | 1733 | 2.A.G;0.T.-;77.-.A | 0.974 | 0.592 |
| 8557995 | 1734 | 74.-.T;121.C.A | 0.973 | 0.210 |
| 8142576 | 1735 | 76.G.-;127.T.G | 0.973 | 0.375 |
| 14816291 | 1736 | -29.A.C;73.A.- | 0.972 | 0.232 |
| 10080185 | 1737 | 19.-.T;89.-.C | 0.971 | 0.565 |
| 1904247 | 1738 | 0.TTA.---;3.C.A;75.-.A | 0.970 | 0.749 |
| 6460821 | 1739 | 16.-.C;77.GA.-- | 0.970 | 0.637 |
| 12738726 | 1740 | 0.-.T;87.-.T | 0.968 | 0.578 |
| 8357730 | 1741 | 87.-.G;129.C.A | 0.968 | 0.270 |
| 12187919 | 1742 | 2.A.-;79.GA.-T | 0.968 | 0.963 |
| 14644862 | 1743 | -29.A.C;0.T.-;2.A.C;76.GG.-C | 0.967 | 0.512 |
| 13101334 | 1744 | -1.GT.--;76.GG.-T | 0.967 | 0.377 |
| 12437808 | 1745 | 1.TAC.---;80.A.- | 0.966 | 0.933 |
| 2672055 | 1746 | 0.T.-;2.A.C;86.C.A | 0.966 | 0.590 |
| 6304109 | 1747 | 16.-.A;76.GG.-C | 0.966 | 0.672 |
| 12214091 | 1748 | 2.A.-;73.A.T | 0.966 | 0.602 |
| 8511126 | 1749 | 76.G.-;78.AG.TC | 0.965 | 0.454 |
| 10473646 | 1750 | 16.C.-;76.GG.-T | 0.965 | 0.499 |
| 8561622 | 1751 | 74.-.T;82.A.- | 0.965 | 0.362 |
| 1981516 | 1752 | 0.T.C;75.C.- | 0.964 | 0.575 |
| 4300894 | 1753 | 4.T.-;77.T.G.T | 0.964 | 0.236 |
| 8084158 | 1754 | 74.-.G | 0.964 | 0.402 |
| 8096194 | 1755 | 75.-.A;87.-.T | 0.964 | 0.605 |
| 2281085 | 1756 | 0.T.-;87.C.T | 0.961 | 0.675 |
| 8063355 | 1757 | 74.T.-;86.-.C | 0.960 | 0.507 |
| 3038327 | 1758 | 1.TA.--;73.-.G | 0.959 | 0.854 |
| 9976817 | 1759 | 19.-.G;79.G.- | 0.958 | 0.737 |
| 13223005 | 1760 | 2.A.G;-3.TAGT.---- | 0.958 | 0.837 |
| 8542589 | 1761 | 75.-.G;98.-.T | 0.957 | 0.875 |
| 3345006 | 1762 | 0.T.-;2.A.G;73.A.T | 0.957 | 0.793 |
| 4217628 | 1763 | 4.T.-;71.-.C | 0.956 | 0.495 |
| 10068711 | 1764 | 19.-.T;76.-.A | 0.956 | 0.689 |
| 10198139 | 1765 | 18.-.G;77.-.T | 0.956 | 0.663 |
| 2463484 | 1766 | 1.TA.--;3.C.A;87.-.T | 0.955 | 0.695 |
| 8490228 | 1767 | 76.-.G;128.T.G | 0.955 | 0.305 |
| 3322121 | 1768 | 0.T.-;2.A.G;80.AG.-T | 0.955 | 0.812 |
| 2458850 | 1769 | 1.TA.--;3.C.A;79.G.- | 0.955 | 0.858 |
| 6626017 | 1770 | 18.C.-;78.A.- | 0.954 | 0.611 |
| 8519520 | 1771 | 76.GG.-T;132.G.T | 0.954 | 0.281 |
| 1974653 | 1772 | 0.T.C;75.-.A | 0.954 | 0.490 |
| 2683428 | 1773 | 120.C.A;2.A.C;0.T.- | 0.954 | 0.253 |
| 4272200 | 1774 | 4.T.-;89.A.G | 0.954 | 0.925 |
| 8193481 | 1775 | 85.TC.-G | 0.953 | 0.701 |
| 6557686 | 1776 | 18.C.A;75.-.G | 0.953 | 0.330 |
| 1860902 | 1777 | 0.TT.--;81.GA.-T | 0.952 | 0.515 |
| 2717874 | 1778 | 2.A.C;0.T.-;80.AG.-T | 0.951 | 0.611 |
| 2882024 | 1779 | 1.-.C;74.-.G | 0.951 | 0.619 |
| 3273132 | 1780 | 0.T.-;2.A.G;77.-.C | 0.951 | 0.397 |
| 441958 | 1781 | -27.C.A;76.GG.-A | 0.949 | 0.205 |
| 14811390 | 1782 | -29.A.C;78.A.- | 0.949 | 0.249 |
| 14802094 | 1783 | -29.A.C;86.-.C | 0.949 | 0.461 |

TABLE 4-continued

Median Enrichment of DME Scaffold Variants

| index | SEQ ID NO | muts_1indexed | MI | 95% CI |
|---|---|---|---|---|
| 10523926 | 1784 | 15.-.T;76.-.A | 0.948 | 0.739 |
| 12742835 | 1785 | 0.-.T;81.GA.-T | 0.948 | 0.383 |
| 8093342 | 1786 | 75.-.A;133.A.C | 0.948 | 0.377 |
| 8490265 | 1787 | 76.-.G;129.C.A | 0.948 | 0.322 |
| 2412848 | 1788 | 1.-.A;76.-.T | 0.947 | 0.632 |
| 8183422 | 1789 | 85.TC.-A | 0.947 | 0.638 |
| 2463159 | 1790 | 1.TA.--;3.C.A;88.-.T | 0.946 | 0.552 |
| 8490433 | 1791 | 76.-.G;133.A.C | 0.946 | 0.318 |
| 2681222 | 1792 | 0.T.-;2.A.C;115.T.G | 0.946 | 0.288 |
| 8480741 | 1793 | 78.A.-;132.G.C | 0.946 | 0.202 |
| 2663534 | 1794 | 0.T.-;2.A.C;77.G.C | 0.946 | 0.861 |
| 8118132 | 1795 | 76.GG.-C;129.C.A | 0.946 | 0.373 |
| 6447398 | 1796 | 16.-.C;55.-.G | 0.945 | 0.768 |
| 2285156 | 1797 | 0.T.-;82.AA.-- | 0.945 | 0.503 |
| 8117520 | 1798 | 76.GG.-C;120.C.A | 0.945 | 0.413 |
| 8603147 | 1799 | 73.A.- | 0.945 | 0.225 |
| 8537609 | 1800 | 75.-.G;124.T.G | 0.944 | 0.366 |
| 2245955 | 1801 | 0.T.-;71.-.C | 0.944 | 0.684 |
| 8161116 | 1802 | 79.G.- | 0.942 | 0.264 |
| 8536998 | 1803 | 75.-.G;119.C.A | 9.942 | 0.370 |
| 8537871 | 1804 | 75.-.G;127.T.C | 0.941 | 0.334 |
| 8543767 | 1805 | 75.-.G;89.A.- | 0.941 | 0.628 |
| 6603080 | 1806 | 18.C.-;55.-.G | 0.941 | 0.707 |
| 13850293 | 1807 | -14.A.C;87.-.G | 0.940 | 0.218 |
| 1852615 | 1808 | 0.TT.--;76.-.A | 0.938 | 0.750 |
| 8208020 | 1809 | 88.G.-;132.G.C | 0.938 | 0.242 |
| 14918769 | 1810 | -29.A.C;2.A.-;76.GG.-A | 0.937 | 0.353 |
| 8223161 | 1811 | 90.-.G | 0.937 | 0.664 |
| 2684123 | 1812 | 0.T.-;2.A.C;126.C.A | 0.936 | 0.262 |
| 2883487 | 1813 | 1.-.C;76.GG.-C | 0.934 | 0.884 |
| 8089075 | 1814 | 75.-.C.AA | 0.934 | 0.299 |
| 13746840 | 1815 | -13.G.T;76.G- | 0.934 | 0.266 |
| 10179608 | 1816 | 18.-.G;73.-.A | 0.933 | 0.587 |
| 8357113 | 1817 | 87.-.G;119.C.A | 0.933 | 0.238 |
| 2570963 | 1818 | 0.T.-;2.A.C;18.C.- | 0.932 | 0.404 |
| 6621548 | 1819 | 18.C.-88.-.T | 0.932 | 0.702 |
| 8543544 | 1820 | 75.-.G;89.-.C | 0.930 | 0.331 |
| 8158269 | 1821 | 79.G.A | 0.928 | 0.860 |
| 3341556 | 1822 | 2.A.G;0.T.-;73.AT.-G | 0.928 | 0.857 |
| 2683151 | 1823 | 119.C.A;2.A.C;0.T.- | 0.928 | 0.288 |
| 8543919 | 1824 | 75.-.G;88.-.T | 0.926 | 0.543 |
| 2570189 | 1825 | 0.T.-;2.A.C;18.-.A | 0.926 | 0.645 |
| 4015474 | 1826 | 3.-.C;86.-.C | 0.926 | 0.838 |
| 2731496 | 1827 | 0.T.-;2.A.C;75.-.G;132.G.C | 0.925 | 0.518 |
| 8480834 | 1828 | 78.A.-;131.A.C | 0.925 | 0.257 |
| 3011827 | 1829 | 1.TA.-- | 0.923 | 0.388 |
| 8592843 | 1830 | 70.-.T;86.-.C | 0.923 | 0.501 |
| 8057655 | 1831 | 73.-.A | 0.923 | 0.547 |
| 8480787 | 1832 | 78.A.-;133.A.C | 0.923 | 0.247 |
| 2249456 | 1833 | 0.T.-;72.-.G | 0.922 | 0.820 |
| 8752628 | 1834 | 55.-.T;76.GG.-A | 0.922 | 0.503 |
| 2274200 | 1835 | 0T.-;99.-.T | 0.921 | 0.848 |
| 8142972 | 1836 | 76.G.-;131.A.C;133.A.C | 0.921 | 0.258 |
| 1252489 | 1837 | -15.T.G;76.GG.-T | 0.921 | 0.236 |
| 14822468 | 1838 | -29.A.C;55.-.T | 0.921 | 0.524 |
| 8357890 | 1839 | 87.-.G;131.A.C | 0.921 | 0.275 |
| 8485265 | 1849 | 76.-.G;88.G.- | 0.920 | 0.453 |
| 14796763 | 1841 | -29.A.C;74.-.C | 0.919 | 0.375 |
| 14796493 | 1842 | -29.A.C;74.T.- | 0.919 | 0.249 |
| 8558538 | 1843 | 74.-.T;133.A.C | 0.919 | 0.281 |
| 7247803 | 1844 | 27.-.C;86.CC.-G | 0.918 | 0.915 |
| 10073442 | 1845 | 19.-.T;88.GA.-C | 0.918 | 0.552 |
| 12133660 | 1846 | 2.A.-;85.TC.-G | 9.918 | 0.916 |
| 2572420 | 1847 | 0.T.-;2.A.C.;19.-.A | 0.917 | 0.558 |
| 8555076 | 1848 | 74.-.T;88.G.- | 0.915 | 0.377 |
| 19607377 | 1849 | 16.C.T;75.-.G | 0.915 | 0.789 |
| 3281290 | 1850 | 2.A.G;0.T.-;88.G.- | 0.915 | 0.699 |
| 12713711 | 1851 | 0.-.T;72.-.A | 0.915 | 0.659 |
| 15408234 | 1852 | -30.C.G;0.T.-;2.A.C | 0.915 | 0.291 |
| 12722990 | 1853 | 0.-.T;79.G.- | 0.915 | 0.499 |
| 8105716 | 1854 | 76.GG.-A;132.G.T | 0.914 | 0.275 |
| 2271180 | 1855 | 0.T.- | 9.913 | 0.381 |
| 10289412 | 1856 | 17.-.T;90.-.G | 0.913 | 0.695 |
| 14807090 | 1857 | -29.A.C;.87.-.T | 0.912 | 0.449 |
| 6108421 | 1858 | 14.-A;72.-.C | 0.910 | 0.863 |
| 8141461 | 1859 | 76.G.-;119.C.A | 0.909 | 0.263 |
| 14350324 | 1860 | -25.A.C;76.-.G | 0.908 | 0.330 |
| 8538135 | 1861 | 130.--T.TAG;133.A.G;75.-.G | 0.906 | 0.421 |
| 8538491 | 1862 | 75.-.G;123.A.C | 0.906 | 0.359 |
| 14292135 | 1863 | -25.A.C;0.T.-;2.A.C | 0.905 | 0.255 |
| 2399779 | 1864 | 1.-.A;75.-.C | 0.904 | 0.626 |
| 8142947 | 1865 | 76.G.-;131.AG.CC | 0.903 | 0.312 |
| 8603195 | 1866 | 73.A.-;131.A.C | 0.902 | 0.229 |
| 3329015 | 1867 | 2.A.G;0.T.-;78.-.T | 0.901 | 0.635 |
| 2457498 | 1868 | 1.TA.--;3.C.A;76.-.A | 0.901 | 0.878 |
| 14799938 | 1869 | -29.A.C;76.G.-;78.A.C | 0.901 | 0.250 |
| 10194359 | 1870 | 18.-.G;82.AA.-- | 0.901 | 0.723 |
| 2461767 | 1871 | 1.TA.--;3.C.A;99.-.G | 0.898 | 0.891 |
| 8128631 | 1872 | 75.-.C;131.AG.CC | 0.898 | 0.298 |
| 6130904 | 1873 | 14.-.A-75.CG.-T | 0.898 | 0.809 |
| 2885480 | 1874 | 1.-.C;77.GA.-- | 0.897 | 0.564 |
| 8565409 | 1875 | 131.A.C;75.CG.-T | 0.896 | 0.289 |
| 8526599 | 1876 | 76.-.T;133.A.C | 0.895 | 0.367 |
| 8542268 | 1877 | 75.-.G;99.-.G | 0.895 | 0.466 |
| 3296935 | 1878 | 0.T.-;2.A.G;98.-.T | 0.894 | 0.819 |
| 8535676 | 1879 | 115.T.G;75.-.G | 0.892 | 0.386 |
| 8530925 | 1880 | 75.-.G;82.-.A | 0.891 | 0.434 |
| 8142901 | 1881 | 76.G.-;134.G.T | 0.890 | 0.290 |
| 8142383 | 1882 | 76.G.-;125.T.G | 0.890 | 0.343 |
| 2054253 | 1883 | 0.TT.--;2.A.G;87.-.T | 0.890 | 0.872 |
| 8001281 | 1884 | 71.T.C | 0.888 | 0.608 |
| 6366788 | 1885 | 17.-.A;86.C.- | 0.888 | 0.797 |
| 12123821 | 1886 | 2.A.-;76.G.-;131.A.C | 0.887 | 0.303 |
| 15159066 | 1887 | -29.A.G;74.T.- | 0.886 | 0.228 |
| 10072842 | 1888 | 19.-.T;87.-.A | 0.886 | 0.612 |
| 1979426 | 1889 | 0.T.C;80.A.- | 0.886 | 0.576 |
| 10193667 | 1890 | 18.-.G;82.A.- | 0.886 | 0.828 |
| 1252029 | 1891 | -15.T.G;76.-.G | 0.885 | 0.316 |
| 4247573 | 1892 | 4.T.-;87.C.A | 0.885 | 0.526 |
| 6110295 | 1893 | 14.-.A;74.-.G | 0.884 | 0.833 |
| 6369429 | 1894 | 17.-.A;76.-.T | 0.884 | 0.672 |
| 6476407 | 1895 | 16.-.C;78.-.T | 0.883 | 0.612 |
| 2309043 | 1896 | 0.T.-;65.GC.-T | 0.883 | 0.649 |
| 10084280 | 1897 | 19.-.T;82.AA.-G | 0.883 | 0.750 |
| 2884850 | 1898 | 1.-.C;76.G.-;78.A.C | 0.882 | 0.492 |
| 2347228 | 1899 | 0.T.-;19.-.G | 0.880 | 0.616 |
| 12737110 | 1900 | 0.-.T;88.-.T | 0.880 | 0.357 |
| 10557558 | 1901 | 15.-.T;78.A.C | 0.879 | 0.710 |
| 1851901 | 1902 | 0.TT.--;74.-.G | 0.878 | 0.824 |
| 6621723 | 1903 | 18.C.-;86.C.- | 0.877 | 0.845 |
| 10567449 | 1904 | 15.-.T;73.A.G | 0.876 | 0.489 |
| 1863878 | 1905 | 0.TT.--;75.C.- | 0.876 | 0.766 |
| 7832261 | 1906 | 55.-.G;132.G.C | 0.876 | 0.807 |
| 15161180 | 1907 | -29.A.G;77.-.A | 0.875 | 0.216 |
| 8545164 | 1908 | 75.-.G;82.AA.-G | 0.875 | 0.569 |
| 7830386 | 1909 | 55.-.G;86.-.C | 0.875 | 0.744 |
| 6077749 | 1910 | 15.TC.-A;76.G.- | 0.875 | 0.859 |
| 8148008 | 1911 | 76.G.-;86.C.- | 0.875 | 0.187 |
| 2278635 | 1912 | 0.T.-;88.-.G | 0.874 | 0.725 |
| 1041817 | 1913 | -17.C.A;75.-.C | 0.873 | 0.246 |
| 2465231 | 1914 | 1.TA.--;3.C.A;82.AA.-T | 0.873 | 0.830 |
| 2266703 | 1915 | 0.T.-;90.-.G | 0.872 | 0.862 |
| 6625678 | 1916 | 18.C.-;78.-.C | 0.872 | 0.580 |
| 8136927 | 1917 | 76.G.-;86.-.C | 0.872 | 0.493 |
| 8093375 | 1918 | 75.-.A;131.A.C | 0.871 | 0.335 |
| 2454809 | 1919 | 1.TA.--;3.C.A;72.-.A | 0.870 | 0.736 |
| 1980576 | 1920 | 0.T.C;76.GG.-T | 0.870 | 0.466 |
| 2271158 | 1921 | 0.T.-;132.G.C | 0.870 | 0.383 |
| 442251 | 1922 | -27.C.A;75.-.C | 0.870 | 0.273 |
| 2350399 | 1923 | 0.T.-;18.-.G | 0.869 | 0.556 |
| 8498500 | 1924 | 78.A.G | 0.869 | 0.356 |
| 8080600 | 1925 | 74.-.G;86.-.C | 0.868 | 0.560 |
| 3328595 | 1926 | 2.A.G;0.T.-;78.AG.-T | 0.868 | 0.824 |
| 8467079 | 1927 | 78.AG.-C | 0.868 | 0.422 |
| 6459918 | 1928 | 16.-.C;77.-.A | 0.866 | 0.523 |
| 2265855 | 1929 | 0.T.-;88.GA.-C | 0.865 | 0.721 |
| 15161451 | 1930 | -29.A.G;79.G.- | 0.865 | 0.291 |
| 8565376 | 1931 | 75.CG.-T;133.A.C | 0.865 | 0.308 |
| 2684676 | 1932 | 0.T.-;2.A.C;131.A.G | 0.864 | 0.347 |
| 6461858 | 1933 | 16.-.C;86.-.A | 0.864 | 0.611 |

TABLE 4-continued

Median Enrichment of DME Scaffold Variants

| index | SEQ ID NO | muts_lindexed | MI | 95% CI |
|---|---|---|---|---|
| 3011807 | 1934 | 1.TA.--;132.G.C | 0.863 | 0.396 |
| 1905700 | 1935 | 0.TTA.---;3.C.A;86.-.C | 0.863 | 0.792 |
| 8440297 | 1936 | 81.GAA.-TT | 0.863 | 0.410 |
| 8752800 | 1937 | 55.-.T;75.-.C | 0.862 | 0.546 |
| 12721020 | 1938 | 0.-.T;75.-.C | 0.862 | 0.449 |
| 441780 | 1939 | -27.C.A;75.-.A | 0.861 | 0.300 |
| 10070497 | 1940 | 19.-.T;76.G.-;78.A.C | 0.861 | 0.561 |
| 8112403 | 1941 | 76.-.A;132.G.T | 0.861 | 0.584 |
| 1002534 | 1942 | -17.C.A;2.A.C;0.T.- | 0.861 | 0.277 |
| 3324612 | 1943 | 0.T.-;2.A.G;78.A.C | 0.861 | 0.737 |
| 3030912 | 1944 | 1.TA.--;78.A.-;80.A.- | 0.861 | 0.838 |
| 10182195 | 1945 | 18.-.G;76.GG.-C | 0.860 | 0.462 |
| 8519380 | 1946 | 76.GG.-T;129.C.A. | 0.860 | 0.207 |
| 8493521 | 1947 | 76.-.G;98.-.T | 0.859 | 0.735 |
| 8128428 | 1948 | 75.-.C;128.T.G | 0.858 | 0.241 |
| 1248006 | 1949 | -15.T.G;88.G.- | 0.857 | 0.217 |
| 5585921 | 1950 | 10.T.C;76.G.- | 0.855 | 0.371 |
| 6127219 | 1951 | 14.-.A;78.A.- | 0.855 | 0.493 |
| 3007558 | 1952 | 1.TA.--;90.-.G | 0.854 | 0.711 |
| 10555821 | 1953 | 15.-.T;80.AG.-T | 0.854 | 0.843 |
| 12747339 | 1954 | 0.-.T;78.A.T | 0.854 | 0.745 |
| 14344892 | 1955 | -25.A.C;75.-.C | 0.853 | 0.296 |
| 10310038 | 1956 | 17.-.T;77.-.T | 0.853 | 0.647 |
| 4303315 | 1957 | 4.T.-;76.G.T | 0.852 | 0.664 |
| 14786751 | 1958 | -29.A.C;55.-.G | 0.851 | 0.737 |
| 15050318 | 1959 | -29.A.G;0.T.-;2.A.C;76.-.G | 0.851 | 0.285 |
| 15240190 | 1960 | -29.A.G;2.A.- | 0.851 | 0.500 |
| 6468525 | 1961 | 16.-.C;91.A.-;93.A.G | 0.849 | 0.652 |
| 2826831 | 1962 | 0.T.-;2.A.C;15.-.T;75.-.G | 0.849 | 0.523 |
| 8212871 | 1963 | 86.-.C;133.A.C | 0.848 | 0.669 |
| 3318144 | 1964 | 2.A.G;0.T.-;82.AA.-T | 0.848 | 0.742 |
| 1246180 | 1965 | -15.T.G;75.-.A | 0.847 | 0.337 |
| 1982591 | 1966 | 0.T.C;66.CT.-G | 0.847 | 0.442 |
| 15166880 | 1967 | -29.A.G;81.GA.-T | 0.847 | 0.253 |
| 1904171 | 1968 | 0.TTA.---;3.C.A;74.-.G | 0.846 | 0.783 |
| 14635061 | 1969 | -29.A.C;0.T.- | 0.846 | 0.382 |
| 8565091 | 1970 | 75.CG.-T;126.C.A. | 0.845 | 0.207 |
| 2725821 | 1971 | 0.T.-;2.A.C;77.GA.--;80.A.T | 0.845 | 0.837 |
| 4259960 | 1972 | 4.T.-;130.T.G | 0.844 | 0.800 |
| 3135495 | 1973 | 1.T.G;3.C.-;75.-.G | 0.844 | 0.791 |
| 14345120 | 1974 | -25.A.C;76.G.- | 0.844 | 0.259 |
| 10071193 | 1975 | 19.-.T;81.G.- | 0.844 | 0.779 |
| 6476304 | 1976 | 16.-.C;78.AG.-T | 0.844 | 0.661 |
| 15175052 | 1977 | -29.A.G;55.-.T | 0.844 | 0.629 |
| 8519203 | 1978 | 76.GG.-T;126.C.A | 0.843 | 0.233 |
| 8173991 | 1979 | 77.GA.-- | 0.843 | 0.383 |
| 12746208 | 1980 | 0.-.T;76.-.G | 0.842 | 0.435 |
| 8133056 | 1981 | 75.-.C;87.-.T | 0.842 | 0.419 |
| 8526626 | 1982 | 76.-.T;131.A.C | 0.841 | 0.223 |
| 1252968 | 1983 | -15.T.G;75.C.- | 0.841 | 0.361 |
| 14646713 | 1984 | -29.A.C;0.T.-;2.A.C;80.A.- | 0.840 | 0.513 |
| 6304778 | 1985 | 16.-.A;77.-.A | 0.840 | 0.462 |
| 8479746 | 1986 | 78.A.-120.C.A | 0.838 | 0.293 |
| 12763666 | 1987 | 0.-.T;55.-.T | 0.838 | 0.783 |
| 2684656 | 1988 | 0.T.-;2.A.C;131.A.C;133.A.C | 0.838 | 0.207 |
| 14800177 | 1989 | -29.A.C;79.G.- | 0.837 | 0.233 |
| 8128118 | 1990 | 75.-.C.124.T.G | 0.837 | 0.256 |
| 13797685 | 1991 | -14.A.C;0.T.-;2.A.C | 0.836 | 0.250 |
| 4259801 | 1992 | 4.T.-;128.T.G | 0.836 | 0.763 |
| 6612829 | 1993 | 18.C.-;76.G.- | 0.833 | 0.708 |
| 448172 | 1994 | -27.C.A;73.A.- | 0.833 | 0.216 |
| 1246589 | 1995 | -15.T.G;76.GG.-C | 0.833 | 0.560 |
| 14796144 | 1996 | -29.A.C;73.-.A | 0.832 | 0.441 |
| 6611642 | 1997 | 18.C.-;76.GG.-A | 0.831 | 0.704 |
| 3040392 | 1998 | 1.TA.--;73.A.T | 0.831 | 0.517 |
| 1938331 | 1999 | 0.TT.--;2.A.C;79.G.- | 0.831 | 0.783 |
| 10528065 | 2000 | 15.-.T;79.GA.-C | 0.831 | 0.713 |
| 3261986 | 2001 | 0.T.-;2.A.G;74.T.G | 0.830 | 0.736 |
| 8131593 | 2002 | 75.-.C;99.-.G | 0.830 | 0.553 |
| 14255597 | 2003 | -24.G.T;2.A.- | 0.830 | 0.570 |
| 14879001 | 2004 | -29.A.C;15.-.T;75.-.G | 0.829 | 0.805 |
| 14918841 | 2005 | -29.A.C;2.A.-;76.GG.-C | 0.829 | 0.732 |
| 2290589 | 2006 | 0.T.-;79.GA.-T | 0.829 | 0.726 |
| 2951795 | 2007 | 1.TA.--;16.-.C | 0.829 | 0.306 |
| 9987799 | 2008 | 19.-.G;86.-.G | 0.827 | 0.731 |
| 15455726 | 2009 | -30.C.G;78.A.- | 0.827 | 0.282 |
| 11812695 | 2010 | -29.A.C;77.-.T | 0.826 | 0.575 |
| 8202480 | 2011 | 87.-.A;131.A.C | 0.825 | 0.570 |
| 8066107 | 2012 | 74.T.-121.C.A | 0.825 | 0.204 |
| 14807234 | 2013 | -29.A.C;86.-.G | 0.824 | 0.174 |
| 10085211 | 2014 | 19.-.T;80.A.- | 0.824 | 0.633 |
| 8180233 | 2015 | 81.GA.-C | 0.873 | 0.428 |
| 1044371 | 2016 | -17.C.A;87.-.G | 0.821 | 0.293 |
| 10286908 | 2017 | 17.-.T;85.TC.-A | 0.821 | 0.502 |
| 10250881 | 2018 | 18.C.T;75.-.G | 0.820 | 0.593 |
| 2463586 | 2019 | 1.TA.--;3.C.A;86.-.G | 0.820 | 0.682 |
| 6554412 | 2020 | 18.C.A;76.G.- | 0.819 | 0.318 |
| 8485725 | 2021 | 76.-.G;98.-.A | 0.818 | 0.716 |
| 2271237 | 2022 | 0.T.-;131.A.C | 0.817 | 0.352 |
| 2564816 | 2023 | 0.T.-;2.A.C;17.-.A | 0.816 | 0.601 |
| 8357229 | 2024 | 87.-.G;120.C.A | 0.816 | 0.329 |
| 12747630 | 2025 | 0.-.T;76.G.-;78.A.T | 0.816 | 0.796 |
| 9972115 | 2026 | 19.-.G;73.-.A | 0.816 | 0.802 |
| 8212329 | 2027 | 86.-.C;121.C.A | 0.815 | 0.514 |
| 14654311 | 2028 | -29.A.C;1.TA.--;76.G.- | 0.815 | 0.380 |
| 1864798 | 2029 | 0.TT.--;73.AT.-G | 0.814 | 0.762 |
| 8117352 | 2030 | 76.GG.-C;119.C.A | 0.813 | 0.433 |
| 8479512 | 2031 | 78.A.-;119.C.A | 0.812 | 0.224 |
| 8133372 | 2032 | 75.-.C;82.A.- | 0.812 | 0.357 |
| 10468894 | 2033 | 16.C.-;87.-.G | 0.812 | 0.667 |
| 8489702 | 2034 | 76.-.G;121.C.A | 0.812 | 0.335 |
| 14919783 | 2035 | -29.A.C;2.A.- | 0.812 | 0.513 |
| 8198335 | 2036 | 86.C.A. | 0.811 | 0.799 |
| 8105698 | 2037 | 76.GG.-A;133.A.C | 0.811 | 0.269 |
| 13845556 | 2038 | -14.A.C;76.GG.-C | 0.809 | 0.491 |
| 3011864 | 2039 | 1.TA.--;132.G.T | 0.809 | 0.352 |
| 13222066 | 2040 | 2.A.G;-3.TAGT.----;76.GG.-A | 0.809 | 0.597 |
| 6471171 | 2041 | 16.-.C;82.A.- | 0.808 | 0.510 |
| 8526572 | 2042 | 132.G.C;76.-.T | 0.808 | 0.259 |
| 8352868 | 2043 | 86.C.-;131.A.C | 0.807 | 0.226 |
| 10198068 | 2044 | 18.-.G;76.G.-;78.A.T | 0.807 | 0.436 |
| 8137025 | 2045 | 76.G.-;89.-.A | 0.804 | 0.538 |
| 8629413 | 2046 | 66.CT.-G;88.G.- | 0.803 | 0.320 |
| 8105428 | 2047 | 76.GG.-A;126.C.A | 0.803 | 0.240 |
| 7947397 | 2048 | 66.CT.-A.87.-.G | 0.802 | 0.362 |
| 7835793 | 2049 | 55.-.G;76.GG.-T | 0.802 | 0.735 |
| 8140338 | 2050 | 76.G.-;116.T.G | 0.802 | 0.306 |
| 12722736 | 2051 | 0.-.T;77.-.C | 0.801 | 0.427 |
| 8757065 | 2052 | 55.-.T;86.C.- | 0.801 | 0.559 |
| 2398681 | 2053 | 1.-.A;75.-.A | 0.801 | 0.641 |
| 4011043 | 2054 | 3.-.C;74.-.C | 0.799 | 0.713 |
| 14920334 | 2055 | -29.A.C;2.A.-;86.C.- | 0.799 | 0.460 |
| 13845318 | 2056 | -14.A.C;76.GG.-A | 0.799 | 0.188 |
| 3427589 | 2057 | 0.T.-;2.A.G;19.-.G | 0.799 | 0.416 |
| 14806422 | 2058 | -29.A.C;89.A.- | 0.798 | 0.702 |
| 15165304 | 2059 | -29.A.G;87.-.T | 0.797 | 0.463 |
| 2125941 | 2060 | 0.TTA.---;3.C.G;89.A.- | 0.797 | 0.791 |
| 15168973 | 2061 | -29.A.G;76.-.T | 0.796 | 0.380 |
| 8538239 | 2062 | 75.-.G;131.AG.CC | 0.796 | 0.429 |
| 8528721 | 2063 | 76.GGA.-TT | 0.796 | 0.447 |
| 7834109 | 2064 | 55.-.G;86.-.G | 0.794 | 0.596 |
| 8476335 | 2065 | 78.A.-;98.-.A | 0.794 | 0.528 |
| 8352802 | 2066 | 132.G.C;86.C.- | 0.794 | 0.214 |
| 10372832 | 2067 | 18.CA.-T;74.-.T | 0.794 | 0.724 |
| 8752727 | 2068 | 55.-.T;76.GG.-C | 0.793 | 0.681 |
| 6460172 | 2069 | 16.-.C;77.-.C | 0.792 | 0.474 |
| 1245741 | 2070 | -15.T.G;74.T.- | 0.792 | 0.347 |
| 6469515 | 2071 | 16.-.C;88.-.T | 0.792 | 0.645 |
| 15241028 | 2072 | -29.A.G;2.A.-;78.A.- | 0.792 | 0.398 |
| 2711056 | 2073 | 0.T.-;2.A.C;82.A.G | 0.791 | 0.747 |
| 1974296 | 2074 | 0.T.C;74.T.- | 0.790 | 0.533 |
| 8637058 | 2075 | 66.CT.-G;86.-.G | 0.789 | 0.254 |
| 8526611 | 2076 | 76.-.T;132.G.T | 0.788 | 0.323 |
| 8144153 | 2077 | 76.G-;119.C.T | 0.788 | 0.240 |
| 10566620 | 2078 | 15.-.T;73.A.G | 0.788 | 0.613 |
| 8557775 | 2079 | 74.-.T;119.C.A | 0.788 | 0.230 |
| 8462867 | 2080 | 79.GA.-T | 0.787 | 0.613 |
| 8549438 | 2081 | 75.C.- | 0.787 | 0.425 |
| 8558414 | 2082 | 74.-.T;129.C.A | 0.787 | 0.255 |
| 8105581 | 2083 | 76.GG-A;129.C.A | 0.787 | 0.259 |

TABLE 4-continued

Median Enrichment of DME Scaffold Variants

| index | SEQ ID NO | muts_1indexed | MI | 95% CI |
|---|---|---|---|---|
| 2281703 | 2084 | 0.T.-;86.C.T | 0.786 | 0.719 |
| 2400499 | 2085 | 1.-.A;76.G.-;78.A.C | 0.785 | 0.482 |
| 14920368 | 2086 | -29.A.C;2.A.-;87.-.G | 0.785 | 0.602 |
| 8543253 | 2087 | 75.-.G;91.A.-;93.A.G | 0.785 | 0.452 |
| 8488707 | 2088 | 76.-.G;116.T.G | 0.785 | 0.283 |
| 9979217 | 2089 | 19.-.G;86.-.C | 0.783 | 0.612 |
| 15162226 | 2090 | -29.A.G;86.-.A | 0.783 | 0.522 |
| 12146137 | 2091 | 2.A.-;116.T.G | 0.783 | 0.429 |
| 5454231 | 2092 | 8.G.C;76.G.- | 0.782 | 0.646 |
| 2288382 | 2093 | 0.T.-;77.GA.--;83.A.T | 0.781 | 0.648 |
| 8549424 | 2094 | 75.C.-;132.G.C | 0.781 | 0.386 |
| 6461529 | 2095 | 16.-.C;85.T.- | 0.781 | 0.720 |
| 1090544 | 2096 | 2.A.- | 0.781 | 0.530 |
| 2282648 | 2097 | 0.T.-;84.-.T | 0.779 | 0.667 |
| 12149194 | 2098 | 2.A.-;131.A.G | 0.779 | 0.440 |
| 8142223 | 2099 | 76.G.-;124.T.G | 0.779 | 0.273 |
| 8190575 | 2100 | 86.CC.-A | 0.779 | 0.611 |
| 13854291 | 2281 | -14.A.C;75.CG.-T | 0.779 | 0.362 |
| 8092813 | 2282 | 75.-.A;121.C.A | 0.778 | 0.281 |
| 8605540 | 2283 | 73.A.-;87.-.G | 0.778 | 0.303 |
| 68946 | 2284 | 0.T.-;2.A.C | 0.778 | 0.250 |
| 12199248 | 2285 | 2.A.-;76.GG.-T;132.G.C | 0.778 | 0.424 |
| 8093073 | 2286 | 126.C.A;75.-.A | 0.778 | 0.370 |
| 12149170 | 2287 | 2.A.-;131.A.C | 0.776 | 0.577 |
| 447600 | 2288 | -27.C.A;75.CG.-T | 0.776 | 0.266 |
| 8143156 | 2289 | 76.G.-;126.C.T | 0.776 | 0.346 |
| 1982252 | 2290 | 0.T.C;73.A.- | 0.776 | 0.441 |
| 4255522 | 2291 | 4.T.-;115.T.G | 0.776 | 0.764 |
| 8112417 | 2292 | 76.-.A;131.A.C | 0.776 | 0.677 |
| 8083653 | 2293 | 74.-.G;121.C.A | 0.775 | 0.434 |
| 8539008 | 2294 | 75.-.G;120.C.T | 0.775 | 0.361 |
| 13750813 | 2295 | -13.G.T;75.-.G | 0.774 | 0.496 |
| 8759144 | 2296 | 55.-.T;76.GG.-T | 0.772 | 0.578 |
| 2684637 | 2297 | 0.T.-;2.A.C;131.AG.CC | 0.771 | 0.251 |
| 8032414 | 2298 | 72.-.C | 0.771 | 0.299 |
| 15165408 | 2299 | -29.A.G;86.-.G | 0.770 | 0.132 |
| 8352728 | 2300 | 86.C.-;129.C.A | 0.770 | 0.200 |
| 12191702 | 2301 | 2.A.-;78.A.-;131.A.C | 0.769 | 0.497 |
| 12751144 | 2302 | 0.-.T;74.-.T | 0.769 | 0.417 |
| 2894079 | 2303 | 1.-.C;87.-.G | 0.768 | 0.697 |
| 8480622 | 2304 | 78.A.-;129.C.A | 0.768 | 0.332 |
| 8758901 | 2305 | 55.-.T;76.-.G | 0.766 | 0.642 |
| 8202090 | 2306 | 87.-.A;121.C.A | 0.766 | 0.622 |
| 2885067 | 2307 | 1.-.C;79.G.- | 0.766 | 0.512 |
| 8202431 | 2308 | 87.-.A;132.G.C | 0.765 | 0.537 |
| 12191659 | 2309 | 2.A.-;78.A.-;132.G.C | 0.765 | 0.596 |
| 12149115 | 2310 | 2.A.-;133.A.C | 0.764 | 0.439 |
| 2271200 | 2311 | 0.T.-;133.A.C | 0.764 | 0.429 |
| 2252404 | 2312 | 0.T.-;74.T.G | 0.763 | 0.476 |
| 8142993 | 2313 | 131.A.G;76.G.- | 0.762 | 0.250 |
| 446438 | 2314 | -27.C.A;78.A.- | 0.762 | 0.249 |
| 8480581 | 2315 | 78.A.-;128.T.G | 0.762 | 0.280 |
| 3133382 | 2316 | 1.T.G;3.C.-;74.-.G | 0.761 | 0.629 |
| 2302762 | 2317 | 0.T.-;73.A.G | 0.761 | 0.618 |
| 1041081 | 2318 | -17.C.A;74.T.- | 0.760 | 0.230 |
| 1074428 | 2319 | -17.C.A;2.A.- | 0.760 | 0.561 |
| 10571409 | 2320 | 15.-.T;65.GC.-T | 0.760 | 0.639 |
| 8598575 | 2321 | 70.-.T;86.C.- | 0.758 | 0.375 |
| 8363306 | 2322 | 87.-.T;131.A.C | 0.757 | 0.452 |
| 8143881 | 2323 | 76.G.-;120.C.T | 0.757 | 0.313 |
| 15159530 | 2324 | -29.A.G;74.-.G | 0.757 | 0.394 |
| 4230077 | 2325 | 4.T.-;75.C.A | 0.756 | 0.733 |
| 8146649 | 2326 | 76.G.-;99.-.G | 0.755 | 0.379 |
| 2684498 | 2327 | 0.T.-;2.A;130.T.G | 0.755 | 0.295 |
| 8128273 | 2328 | 75.-.C;126.C.A | 0.754 | 0.277 |
| 8066406 | 2329 | 74.T.-;126.C.A | 0.752 | 0.237 |
| 8363243 | 2330 | 87.-.T;132.G.C | 0.751 | 0.469 |
| 8142864 | 2331 | 76.G.-;132.GA.CC | 0.751 | 0.276 |
| 2512825 | 2332 | 1.T.C;76.G.- | 0.750 | 0.486 |
| 8091801 | 2333 | 75.-.A;115.T.G | 0.750 | 0.260 |
| 1114939 | 2334 | -16.C.A;76.G.- | 0.749 | 0.264 |
| 8142311 | 2335 | 76.G.-;125.T.C | 0.749 | 0.291 |
| 11774438 | 2336 | 2.-.C;76.GG.-A | 0.748 | 0.658 |
| 15064284 | 2337 | -29.A.G;1.TA.-- | 0.748 | 0.383 |
| 1187746 | 2338 | -15.T.G;0.T.- | 0.748 | 0.384 |
| 8092581 | 2339 | 75.-.A;119.C.A | 0.747 | 0.330 |
| 1246493 | 2340 | -15.T.G;76.-.A | 0.747 | 0.493 |
| 14646216 | 2341 | -29.A.C;0.T.-;2.A.C;87.-.G | 0.747 | 0.369 |
| 8142526 | 2342 | 76.G.-;127.T.C | 0.746 | 0.249 |
| 8191621 | 2343 | 85.TCC.-GA | 0.746 | 0.479 |
| 10308897 | 2344 | 17.-.T;78.A.G | 0.745 | 0.691 |
| 14661314 | 2345 | -29.A.C;0.T.-;2.A.G;75.-.C | 0.745 | 0.570 |
| 8549337 | 2346 | 75.C.-;129.C.A | 0.745 | 0.299 |
| 8753061 | 2347 | 55.-.T;79.G.- | 0.745 | 0.514 |
| 10097262 | 2348 | 19.-.T;55.-.T | 0.745 | 0.583 |
| 8161158 | 2349 | 79.G.-;131.A.C | 0.744 | 0.215 |
| 2661991 | 2350 | 0.T.-;2.A.C;76.G.-;131.A.C | 0.743 | 0.432 |
| 9987131 | 2351 | 19.-.G;86.C.- | 0.743 | 0.684 |
| 1046156 | 2352 | -17.C.A;76.CG.-T | 0.743 | 0.206 |
| 3311900 | 2353 | 0.T.-;2.A.G;83.-.C | 0.743 | 0.541 |
| 2412608 | 2354 | 1.-.A;76.GG.-T | 0.742 | 0.454 |
| 8092717 | 2355 | 75.-.A;120.C.A | 0.740 | 0.353 |
| 2684366 | 2356 | 0.T.-;2.A.C;128.T.G | 0.740 | 0.320 |
| 8536239 | 2357 | 75.-.G;116.T.G | 0.740 | 0.409 |
| 8483969 | 2358 | 78.A.-;98.-.T | 0.739 | 0.635 |
| 1290147 | 2359 | -15.T.G;2.A.-;76.G.- | 0.737 | 0.358 |
| 8629656 | 2360 | 66.CT.-G;89.-.A | 0.737 | 0.644 |
| 8039677 | 2361 | 72.-.G;86.-.C | 0.736 | 0.628 |
| 8528174 | 2362 | 76.-.T;87.-.G | 0.736 | 0.316 |
| 8142772 | 2363 | 76.G.-;130.T.C | 0.736 | 0.350 |
| 12148593 | 2364 | 2.A.-;126.C.A | 0.736 | 0.541 |
| 8089812 | 2365 | 75.-.A;88.G- | 0.736 | 0.622 |
| 8436907 | 2366 | 81.GA.-T;131.A.C | 0.734 | 0.289 |
| 6303279 | 2367 | 16.-.A;74.-.G | 0.733 | 0.706 |
| 8136856 | 2368 | 76.G.-;88.G.- | 0.732 | 0.393 |
| 13099840 | 2369 | -1.GT.--;87.-.G | 0.732 | 0.205 |
| 12147390 | 2370 | 2.A.-;119.C.A | 0.731 | 0.364 |
| 8480763 | 2371 | 78.A.-;130.T.G | 0.731 | 0.307 |
| 8145151 | 2372 | 76.G.-;113.A.C | 0.729 | 0.240 |
| 2682115 | 2373 | 116.T.G;2.A.C;0.T.- | 0.726 | 0.269 |
| 2397740 | 2374 | 1.-.A;73.-.A | 0.775 | 0.570 |
| 8477975 | 2375 | 78.A.-;115.T.G | 0.725 | 0.258 |
| 10190335 | 2376 | 18.-.G;99.-.G | 0.725 | 0.472 |
| 15456232 | 2377 | -30.C.G;76.GG.-T | 0.725 | 0.153 |
| 1191613 | 2378 | -15.T.G;0.T.-;2.A.C;76.G.- | 0.724 | 0.396 |
| 8352255 | 2379 | 86.C.-;121.C.A | 0.723 | 0.142 |
| 8212804 | 2380 | 86.-.C;130.T.G | 0.722 | 0.481 |
| 8549476 | 2381 | 132.G.T;75.C.- | 0.721 | 0.390 |
| 9994620 | 2382 | 19.-.G;77.-.T | 0.721 | 0.613 |
| 14350752 | 2383 | -25.A.C;76.GG.-T | 0.721 | 0.132 |
| 13099030 | 2384 | -1.GT.-- | 0.721 | 0.376 |
| 12147928 | 2385 | 2.A.-;121.C.A | 0.721 | 0.488 |
| 1253117 | 2386 | -15.T.G;74.-.T | 0.720 | 0.253 |
| 8208073 | 2387 | 88.G.-;131.A.C | 0.719 | 0.210 |
| 2684254 | 2388 | 0.T.-;2.A.C;127.T.G | 0.719 | 0.353 |
| 8154688 | 2389 | 76.G.-;78.A.C;132.G.C | 0.719 | 0.383 |
| 318717 | 2390 | -28.G.C;76.G.- | 0.719 | 0.192 |
| 8142885 | 2391 | 130.--T.TAG;133.A.G;76.G.- | 0.719 | 0.301 |
| 14687527 | 2392 | -29.A.C;4.T.-;78.A.- | 0.718 | 0.527 |
| 15162677 | 2393 | -29.A.G;89.-.A | 0.718 | 0.668 |
| 15450951 | 2394 | -30.C.G;76.GG.-C | 0.717 | 0.477 |
| 8405267 | 2395 | 82.AA.-- | 0.716 | 0.292 |
| 8066712 | 2396 | 74.T.-;132.G.T | 0.716 | 0.310 |
| 8112393 | 2397 | 76.-.A;133.A.C | 0.715 | 0.480 |
| 8564706 | 2398 | 75.CG.-T;120.C.A | 0.715 | 0.237 |
| 8538090 | 2399 | 75.-.G;130.T.C | 0.715 | 0.386 |
| 14081741 | 2400 | -20.A.C;76.G.- | 0.714 | 0.177 |
| 8357562 | 2401 | 87.-.G;126.C.A | 0.713 | 0.285 |
| 6476171 | 2402 | 16.-.C;78.A.G | 0.713 | 0.677 |
| 12145038 | 2403 | 2.A.-;115.T.G | 0.713 | 0.524 |
| 8636771 | 2404 | 66.CT.-G;88.-.T | 0.712 | 0.372 |
| 8208060 | 2405 | 88.G.-;132.G.T | 0.712 | 0.261 |
| 2746161 | 2406 | 0.T.-;2.C.G;66.CT.-G;132.G.C | 0.711 | 0.362 |
| 8064859 | 2407 | 74.T.-;115.T.G | 0.711 | 0.210 |
| 1981797 | 2408 | 0.T.C;75.CG.-T | 0.711 | 0.646 |
| 15719823 | 2409 | -32.G.T;0.T.-;2.A.C | 0.710 | 0.271 |
| 3024059 | 2410 | 1.TA.--;82.AA.-C | 0.710 | 0.373 |
| 14806152 | 2411 | -29.A.C;89.-.C | 0.709 | 0.182 |
| 14634677 | 2412 | -29.A.C;0.T.-;76.G.- | 0.708 | 0.421 |
| 672656 | 2413 | -23.C.A;75.-.G | 0.708 | 0.430 |

TABLE 4-continued

Median Enrichment of DME Scaffold Variants

| index | SEQ ID NO | muts_lindexed | MI | 95% CI |
|---|---|---|---|---|
| 8628797 | 2414 | 66.CT.-G;77.GA.-- | 0.708 | 0.333 |
| 10529623 | 2415 | 15.-.T;85.TC.-A | 0.708 | 0.506 |
| 10196969 | 2416 | 18.-.G;78.A.- | 0.707 | 0.698 |
| 8057272 | 2417 | 73.-.A;121.C.A | 0.707 | 0.370 |
| 13845728 | 2418 | -14.A.C;75.-.C | 0.707 | 0.297 |
| 1045822 | 2419 | -17.C.A;76.-.G | 0.706 | 0.324 |
| 10460865 | 2420 | 16.C.-;76.GG.-C | 0.706 | 0.523 |
| 4222138 | 2421 | 4.T.-72.-.G | 0.705 | 0.401 |
| 1152457 | 2422 | -15.T.C;0.T.-;2.A.C | 0.704 | 0.351 |
| 8069945 | 2423 | 74.T.-;87.-.T | 0.704 | 0.402 |
| 6303440 | 2424 | 16.-.A;75.-.A | 0.704 | 0.657 |
| 5593794 | 2425 | 10.T.C;75.CG.-T | 0.704 | 0.281 |
| 14654654 | 2426 | -29.A.C;1.TA.-- | 0.703 | 0.363 |
| 7829345 | 2427 | 55.-.G;76.GG.-C | 0.703 | 0.651 |
| 7490581 | 2428 | 36.C.A;76.GG.-C | 0.703 | 0.439 |
| 15452184 | 2429 | -30.C.G;86.-.C | 0.702 | 0.465 |
| 8089736 | 2430 | 75.-.A;87.-.A | 0.702 | 0.404 |
| 3161365 | 2431 | 0.T.-;2.A.G;14.-.A | 0.702 | 0.700 |
| 8215458 | 2432 | 88.GA.-C | 0.702 | 0.286 |
| 2455947 | 2433 | 1.TA.--;3.C.A;73.-.A | 0.702 | 0.693 |
| 827787 | 2434 | -21.C.A;76.G.- | 0.702 | 0.246 |
| 3574182 | 2435 | 2.-.A;55.-.G | 0.701 | 0.681 |
| 8504697 | 2436 | 78.-.T | 0.701 | 0.457 |
| 8147538 | 2437 | 76.G.-;91.A.-;93.A.G | 0.701 | 0.391 |
| 8436856 | 2438 | 81.GA.-T;132.G.C | 0.700 | 0.199 |
| 8110287 | 2439 | 76.-.A;86.-.C | 0.700 | 0.448 |
| 8598693 | 2440 | 70.-.T;87.-.T | 0.700 | 0.315 |
| 4260194 | 2441 | 4.T.-;129.C.T | 0.699 | 0.510 |
| 8059622 | 2442 | 73.-.A;87.-.G | 0.699 | 0.389 |
| 8586230 | 2443 | 73.AT.-G | 0.699 | 0.265 |
| 8126524 | 2444 | 75.-.C;115.T.G | 0.699 | 0.336 |
| 10084621 | 2445 | 19.-.T;82.AA.-T | 0.699 | 0.642 |
| 10607021 | 2446 | 16.C.T;78.A.- | 0.698 | 0.567 |
| 8212230 | 2447 | 86.-.C;120.C.A | 0.698 | 0.505 |
| 2664493 | 2448 | 0.T.-;2.A.C;79.G.A | 0.698 | 0.640 |
| 2203429 | 2449 | 0.T.-;18.C.- | 0.698 | 0.407 |
| 8605503 | 2450 | 73.A.-;86.C.- | 0.697 | 0.200 |
| 13852662 | 2451 | -14.A.C;78.A.- | 0.697 | 0.309 |
| 8546163 | 2452 | 75.C.-;86.-.C | 0.697 | 0.445 |
| 446575 | 2453 | -27.C.A;76.-.G | 0.696 | 0.351 |
| 8065997 | 2454 | 74.T.-;120.C.A | 0.696 | 0.234 |
| 11888602 | 2455 | 2.A.C;75.-.G | 0.696 | 0.515 |
| 8536608 | 2456 | 75.-.G;118.T.C | 0.694 | 0.323 |
| 14797194 | 2457 | -29.A.C;74.-.G | 0.694 | 0.384 |
| 15166776 | 2458 | -29.A.G;82.AA.-T | 0.694 | 0.237 |
| 14800643 | 2459 | -29.A.C;77.GA.-- | 0.693 | 0.379 |
| 8030604 | 2460 | 72.-.C;86.-.C | 0.692 | 0.345 |
| 2464748 | 2461 | 1.TA.--;3.C.A;82.AA.-C | 0.692 | 0.574 |
| 8493269 | 2462 | 76.-.G;99.-.G | 0.691 | 0.356 |
| 8549456 | 2463 | 75.C.-;133.A.C | 0.691 | 0.458 |
| 2307776 | 2464 | 0.T.-;66.CT.-- | 0.690 | 0.673 |
| 6306305 | 2465 | 16.-.A;86.-.C | 0.690 | 0.602 |
| 8126956 | 2466 | 75.-.C;116.T.G | 0.690 | 0.278 |
| 14809754 | 2467 | -29.A.C;81.GA.-T | 0.688 | 0.296 |
| 8212714 | 2468 | 86.-.C;128.T.G | 0.688 | 0.369 |
| 1251890 | 2469 | -15.T.G;78.A.- | 0.687 | 0.319 |
| 8518607 | 2470 | 76.GG.-T;119.C.A | 0.687 | 0.191 |
| 8057702 | 2471 | 73.-.A;131.A.C | 0.686 | 0.432 |
| 3024866 | 2472 | 1.TA.--;82.AA.-G | 0.686 | 0.454 |
| 8367599 | 2473 | 86.-.G;133.A.C | 0.686 | 0.157 |
| 8431922 | 2474 | 82.AA.-T | 0.686 | 0.217 |
| 8144351 | 2475 | 76.G.-;117.G.T | 0.685 | 0.239 |
| 8538257 | 2476 | 75.-.G;131.A.C;133.A.C | 0.685 | 0.419 |
| 8543064 | 2477 | 75.-.G;91.A.- | 0.685 | 0.640 |
| 15455856 | 2478 | -30.C.G;76.-.G | 0.685 | 0.299 |
| 12149015 | 2479 | 2.A.-;130.T.G | 0.685 | 0.459 |
| 2685087 | 2480 | 0.T.-;2.A.C;122.A.C | 0.684 | 0.234 |
| 8084140 | 2481 | 74.-.G;132.G.C | 0.683 | 0.396 |
| 8142757 | 2482 | 76.G.-;130.T.C;132.G.C | 0.683 | 0.272 |
| 8538197 | 2483 | 75.-.G;134.G.T | 0.683 | 0.368 |
| 15058053 | 2484 | -29.A.G;0.T.-;2.A.C;76.GG.-C | 0.683 | 0.336 |
| 8066567 | 2485 | 74.T.-;129.C.A | 0.681 | 0.266 |
| 441402 | 2486 | -27.C.A;74.T.- | 0.681 | 0.300 |
| 1042785 | 2487 | -17.C.A;86.-.C | 0.679 | 0.335 |
| 8490149 | 2488 | 76.-.G;127.T.G | 0.678 | 0.293 |
| 1905560 | 2489 | 0.TTA.---;3.C.A;87.-.A | 0.678 | 0.635 |
| 8352170 | 2490 | 86.C.-;120.C.A | 0.678 | 0.182 |
| 1252598 | 2491 | -15.T.G;76.-.T | 0.678 | 0.235 |
| 2400384 | 2492 | 1.-.A;77.-.A | 0.678 | 0.356 |
| 8087722 | 2493 | 74.-.G;86.C.- | 0.676 | 0.432 |
| 8101522 | 2494 | 75.-.C.AG | 0.676 | 0.285 |
| 8087834 | 2495 | 74.-.G;87.-.T | 0.676 | 0.449 |
| 8431908 | 2496 | 82.AA.-T;132.G.C | 0.676 | 0.225 |
| 14645411 | 2497 | -29.A.C;0.T.-;2.A.C;86.-.C | 0.676 | 0.635 |
| 2835829 | 2498 | 0.T.-;2.A.C;6.G.T | 0.675 | 0.298 |
| 8438736 | 2499 | 81.GAA.-TC | 0.674 | 0.360 |
| 8065838 | 2500 | 74.T.-;119.C.A | 0.673 | 0.209 |
| 15171004 | 2501 | -29.A.G;73.A.- | 0.673 | 0.259 |
| 8084203 | 2502 | 74.-.G131.A.C | 0.673 | 0.327 |
| 15161712 | 2503 | -29.A.G;77.GA.-- | 0.672 | 0.388 |
| 6613064 | 2504 | 18.C.-;77.-.A | 0.672 | 0.551 |
| 12315000 | 2505 | 2.A.-;15.-.T;75.-.G | 0.672 | 0.635 |
| 14246167 | 2506 | -24.G.T;75.-.G | 0.672 | 0.308 |
| 15051656 | 2507 | -29.A.G;0.T.- | 0.671 | 0.366 |
| 8469914 | 2508 | 78.-.C;121.C.A | 0.671 | 0.232 |
| 8352836 | 2509 | 86.C.-;133.A.C | 0.670 | 0.207 |
| 8554990 | 2510 | 74.-.T;87.-.A | 0.670 | 0.490 |
| 830076 | 2511 | -21.C.A;75.-.G | 0.670 | 0.422 |
| 8538376 | 2512 | 75.-.G;126.C.G | 0.670 | 0.370 |
| 15451096 | 2513 | -30.C.G;75.-.C | 0.670 | 0.236 |
| 1290476 | 2514 | -15.T.G;2.A.- | 0.669 | 0.658 |
| 14644913 | 2515 | -29.A.C;0.T.-;2.A.C;75.-.C | 0.668 | 0.335 |
| 8481064 | 2516 | 78.A.-;123.A.C | 0.667 | 0.232 |
| 12726534 | 2517 | 0.-.T;86.-.C | 0.666 | 0.531 |
| 14814019 | 2518 | -29.A.C;75.C.- | 0.666 | 0.397 |
| 15450607 | 2519 | -30.C.G;75.-.A | 0.665 | 0.225 |
| 8512477 | 2520 | 76.G.-;78.A.T;132.G.C | 0.665 | 0.478 |
| 1247921 | 2521 | -15.T.G;87.-.A | 0.665 | 0.476 |
| 6461965 | 2522 | 16.-.C;86.CC.-A | 0.664 | 0.620 |
| 14815751 | 2523 | -29.A.C;73.A.G | 0.663 | 0.362 |
| 8557906 | 2524 | 74.-.T;120.C.A | 0.663 | 0.196 |
| 8174025 | 2525 | 77.GA.--;132.G.T | 0.663 | 0.265 |
| 1979872 | 2526 | 0.T.C;78.-.C | 0.66;3 | 0.404 |
| 8148116 | 2527 | 76.G.-;87.-.T | 0.662 | 0.584 |
| 8055441 | 2528 | 73.-.A;86.-.C | 0.662 | 0.471 |
| 15162449 | 2529 | -29.A.G;88.G.- | 0.662 | 0.206 |
| 8522485 | 2530 | 76.GGA.-TC | 0.662 | 0.401 |
| 3081068 | 2531 | 1.TA.--;18.-.G | 0.662 | 0.556 |
| 8117952 | 2532 | 76.GG.-C;126.C.A | 0.661 | 0.381 |
| 6469397 | 2533 | 16.-.C;89.-.T | 0.661 | 0.591 |
| 8181855 | 2534 | 85.TCC.-AA | 0.661 | 0.568 |
| 1044315 | 2535 | -17.C.A;86.C.- | 0.661 | 0.167 |
| 14920528 | 2536 | -29.A.C;2.A.-;82.A.- | 0.659 | 0.536 |
| 8518772 | 2537 | 76.GG-T;120.C.A | 0.659 | 0.283 |
| 15058093 | 2538 | -29.A.G;0.T.-;2.A.C;75.-.C | 0.658 | 0.434 |
| 8057683 | 2539 | 132.G.T;73.-.A | 0.657 | 0.434 |
| 2459622 | 2540 | 1.TA.--;3.C.A;86.-.A | 0.656 | 0.656 |
| 8069834 | 2541 | 74.T.-;86.C.- | 0.656 | 0.293 |
| 3320802 | 2542 | 2.A.G;0.T.-;80.A.- | 0.656 | 0.611 |
| 14919186 | 2543 | -29.A.C;2.A.-;77.GA.-- | 0.655 | 0.360 |
| 8207846 | 2544 | 88.G.-;126.C.A | 0.655 | 0.244 |
| 447545 | 2545 | -27.C.A;76.-.T | 0.655 | 0.227 |
| 8603132 | 2546 | 73.A.-;132.G.C | 0.654 | 0.247 |
| 8755264 | 2547 | 55.-.T;132.G.C | 0.654 | 0.548 |
| 443309 | 2548 | -27.C.A;86.-.C | 0.653 | 0.447 |
| 8548846 | 2549 | 75.C.-;121.C.A | 0.653 | 0.455 |
| 815029 | 2550 | 77.-.A;132.G.T | 0.652 | 0.274 |
| 8603165 | 2551 | 73.A.-;133.A.C | 0.652 | 0.298 |
| 12312790 | 2552 | 16.C.-;2.A.- | 0.652 | 0.524 |
| 10248608 | 2553 | 18.C.T;76.G.- | 0.651 | 0.536 |
| 1046713 | 2554 | -17.C.A;75.CG.-T | 0.651 | 0.263 |
| 8638044 | 2555 | 66.CT.-G;82.AA.-T | 0.651 | 0.287 |
| 3315325 | 2556 | 0.T.-;2.A.G;82.AA.-C | 0.650 | 0.605 |
| 12314014 | 2557 | 2.A.-;15.-.T;76.G.- | 0.649 | 0.574 |
| 8494400 | 2558 | 76.-.G;86.C.- | 0.649 | 0.187 |
| 14920881 | 2559 | -29.A.C;2.A.-;80.A.- | 0.648 | 0.517 |
| 14243707 | 2560 | -24.G.T;76.G.- | 0.648 | 0.185 |
| 12148911 | 2561 | 2.A.-;129.C.A | 0.647 | 0.601 |
| 12149062 | 2562 | 2.A.-;132.G.C | 0.646 | 0.502 |
| 8600526 | 2563 | 73.A.-;88.G.- | 0.645 | 0.440 |

TABLE 4-continued

Median Enrichment of DME Scaffold Variants

| index | SEQ ID NO | muts_lindexed | MI | 95% CI |
|---|---|---|---|---|
| 8538871 | 2564 | 75.-.G;121.C.T | 0.645 | 0.402 |
| 8603181 | 2565 | 73.A.-;132.G.T | 0.645 | 0.289 |
| 15450764 | 2566 | -30.C.G;76.GG.-A | 0.644 | 0.211 |
| 12149230 | 2567 | 2.A.-;129.C.G | 0.643 | 0.340 |
| 8558338 | 2568 | 74.-.T;127.T.G | 0.643 | 0.272 |
| 8367575 | 2569 | 86.-.G;132.G.C | 0.642 | 0.146 |
| 14647726 | 2570 | -29.A.C;0.T.-;2.A.C;66.CT.-G | 0.641 | 0.378 |
| 8490463 | 2571 | 76.-.G;131.AG.CC | 0.640 | 0.222 |
| 12123507 | 2572 | 2.A.-;76.G.-;121.C.A | 0.640 | 0.452 |
| 8352850 | 2573 | 86.C.-;132.G.T | 0.640 | 0.245 |
| 12191691 | 2574 | 2.A.-;78.A.-;132.G.T | 0.639 | 0.499 |
| 8638264 | 2575 | 66.CT.-G;80.A.- | 0.639 | 0.282 |
| 1195928 | 2576 | -15.T.G;1.TA.-- | 0.639 | 0.361 |
| 1979286 | 2577 | 0.T.C;81.GA.-T | 0.639 | 0.548 |
| 8207662 | 2578 | 88.G.-;121.C.A | 0.638 | 0.120 |
| 6460643 | 2579 | 16.-.C;81.G- | 0.638 | 0.572 |
| 2686745 | 2580 | 0.T.-;2.A.C;113.A.C | 0.638 | 0.276 |
| 1045705 | 2581 | -17.C.A;78.A.- | 0.638 | 0.262 |
| 8600457 | 2582 | 73.A.-;87.-.A | 0.636 | 0.454 |
| 7948057 | 2583 | 66.CT.-A;76.-.G | 0.636 | 0.380 |
| 10091271 | 2584 | 19.-.T;73.AT.-C | 0.636 | 0.542 |
| 442030 | 2585 | -27.C.A;76.-.A | 0.636 | 0.592 |
| 844891 | 2586 | 2.A.-;-21.C.A | 0.633 | 0.622 |
| 10516019 | 2587 | 15.-.T;71.-.C | 0.633 | 0.534 |
| 12016332 | 2588 | 2.A.-;18.C.- | 0.632 | 0.463 |
| 8073253 | 2589 | 74.-.C;132.G.C; | 0.632 | 0.356 |
| 8357699 | 2590 | 87.-.G;128.T.G | 0.630 | 0.335 |
| 2684905 | 2591 | 0.T.-;2.A.C;123.A.C | 0.630 | 0.301 |
| 2684593 | 2592 | 0.T.-;2.A.C;134.G.T | 0.630 | 0.258 |
| 12149142 | 2593 | 2.A.-;132.G.T | 0.630 | 0.481 |
| 2881692 | 2594 | 1.-.C;74.-.C | 0.628 | 0.531 |
| 5590003 | 2595 | 87.-.G;10.T.C | 0.628 | 0.471 |
| 12123808 | 2596 | 132.G.T;2.A.-;76.G.- | 0.628 | 0.327 |
| 8212595 | 2597 | 86.-.C;126.C.A | 0.627 | 0.514 |
| 8173470 | 2598 | 77.GA.---;121.C.A | 0.627 | 0.292 |
| 8034488 | 2599 | 72.-.C;82.A.- | 0.627 | 0.141 |
| 2411142 | 2600 | 1.-.A;78.-.C | 0.626 | 0.400 |
| 8096384 | 2601 | 75.-.A;82.A.- | 0.626 | 0.418 |
| 2723173 | 2602 | 0.T.-;2.A.C;76.-.G;132.G.C | 0.626 | 0.320 |
| 8118097 | 2603 | 76.GG.-C;128.T.G | 0.625 | 0.405 |
| 8543409 | 2604 | 75.-.G;91.AA.-G | 0.625 | 0.400 |
| 14812614 | 2605 | -29.A.C;76.G.-;78.A.T | 0.625 | 0.410 |
| 6476723 | 2606 | 16.-.C;76.G.-;78.A.T | 0.624 | 0.568 |
| 8519286 | 2607 | 76.GG.-T;127.T.G | 0.624 | 0.239 |
| 8501650 | 2608 | 78.AG.-T | 0.623 | 0.440 |
| 8208050 | 2609 | 88.G.-;133.A.C | 0.623 | 0.206 |
| 8549499 | 2610 | 75.C.-;131.A.C | 0.623 | 0.381 |
| 12009703 | 2611 | 2.A.-;17.-.A | 0.673 | 0.617 |
| 8128850 | 2612 | 75.-.C;123.A.C | 0.623 | 0.272 |
| 1862825 | 2613 | 0.TT.--;78.-.T | 0.622 | 0.588 |
| 6368672 | 2614 | 17.-.A;78.-.C | 0.622 | 0.607 |
| 8519348 | 2615 | 76.GG.-T;128.T.G | 0.622 | 0.277 |
| 1041692 | 2616 | -17.C.A;76.GG.-C | 0.622 | 0.482 |
| 8018631 | 2617 | 72.-.A | 0.621 | 0.469 |
| 8066533 | 2618 | 74.T.-;128.T.G | 0.619 | 0.261 |
| 8436892 | 2619 | 81.GA.-T;132.G.T | 0.619 | 0.154 |
| 8636610 | 2620 | 66.CT.-G;89.A.- | 0.618 | 0.524 |
| 2884910 | 2621 | 1.-.C;77.-.C | 0.617 | 0.494 |
| 8143053 | 2622 | 76.G.-;129.C.T | 0.617 | 0.285 |
| 8356385 | 2623 | 87.-.G;115.T.G | 0.616 | 0.348 |
| 8561418 | 2624 | 74.-.T;87.-.T | 0.616 | 0.531 |
| 6467416 | 2625 | 16.-.C;99.-.G | 0.615 | 0.507 |
| 2723199 | 2626 | 0.T.-;2.A.C;76.-.G;132.G.T | 0.615 | 0.389 |
| 13746674 | 2627 | -13.G.T;75.-.C | 0.614 | 0.317 |
| 15736191 | 2628 | -32.G.T;76.G.- | 0.614 | 0.181 |
| 2950619 | 2629 | 1.TA.--;17.T.C | 0.613 | 0.330 |
| 1250048 | 2630 | -15.T.G;87.-.G | 0.612 | 0.301 |
| 8519441 | 2631 | 76.GG.-T;130.T.G | 0.611 | 0.227 |
| 8174044 | 2632 | 77.GA.--;131.A.C | 0.611 | 0.368 |
| 8083913 | 2633 | 74.-.G;126.C.A | 0.610 | 0.361 |
| 6554290 | 2634 | 18.C.A;75.-.C | 0.610 | 0.248 |
| 8481228 | 2635 | 78.A.-;122.A.C | 0.610 | 0.293 |
| 14004700 | 2636 | -19.G.T;0.T.-;2.A.C | 0.610 | 0.268 |
| 481605 | 2637 | -27.C.A;2.A.- | 0.610 | 0.487 |
| 2262447 | 2638 | 0.T.-;81.GA.-C | 0.608 | 0.518 |
| 2683891 | 2639 | 0.T.-;2.A.C;124.T.G | 0.608 | 0.300 |
| 2685505 | 2640 | 0.T.-;2.A.C;120.C.T | 0.608 | 0.287 |
| 827692 | 2641 | -21.C.A;75.-.C | 0.608 | 0.315 |
| 13101663 | 2642 | -1.GT.--;74.-.T | 0.607 | 0.272 |
| 2271017 | 2643 | 0.T.-;128.T.G | 0.607 | 0.345 |
| 8066699 | 2644 | 74.T.-;133.A.C | 0.607 | 0.229 |
| 8118193 | 2645 | 76.GG.-C;130.T.G | 0.607 | 0.534 |
| 8073290 | 2646 | 74.-.C;132.G.T | 0.606 | 0.307 |
| 1117646 | 2647 | -16.C.A;75.-.G | 0.606 | 0.417 |
| 444910 | 2648 | -27.C.A;86.C.- | 0.605 | 0.107 |
| 8563682 | 2649 | 75.CG.-T;115.T.G | 0.605 | 0.210 |
| 14645196 | 2650 | -29.A.C;0.T.-;2.A.C;77.GA.-- | 0.604 | 0.451 |
| 14663089 | 2651 | -29.A.C;0.T.-;2.A.G;76.-.G | 0.604 | 0.579 |
| 8480843 | 2652 | 78.A.-;131.A.C;133.A.C | 0.603 | 0.221 |
| 15241063 | 2653 | -29.A.G;2.A.-;76.-.G | 0.603 | 0.535 |
| 8128353 | 2654 | 75.-.C;127.T.G | 0.603 | 0.246 |
| 12202830 | 2655 | 2.A.-;75.-.G;131.A.C | 0.602 | 0.300 |
| 2516661 | 2656 | 1.T.C;76.-.G | 0.602 | 0.569 |
| 8600854 | 2657 | 73.A.-;98.-.A | 0.601 | 0.555 |
| 15158807 | 2658 | -29.A.G;73.-.A | 0.600 | 0.594 |
| 12147720 | 2659 | 2.A.-;120.C.A | 0.600 | 0.524 |
| 14344554 | 2660 | -25.A.C;76.GG.-A | 0.600 | 0.212 |
| 3133295 | 2661 | 1.T.G;3.C.-;74.T.- | 0.600 | 0.541 |
| 3601058 | 2662 | 2.-.A;76.GG.-T | 0.599 | 0.520 |
| 8562045 | 2663 | 74.-.T;82.AA.-T | 0.599 | 0.257 |
| 8080686 | 2664 | 74.-.G89.-.A | 0.599 | 0.542 |
| 8116266 | 2665 | 76.GG.-C;115.T.G | 0.599 | 0.439 |
| 8528148 | 2666 | 76.-.T;86.C.- | 0.598 | 0.268 |
| 14809572 | 2667 | -29.A.C;82.AA.-T | 0.597 | 0.169 |
| 1041548 | 2668 | -17.C.A;76.GG.-A | 0.597 | 0.348 |
| 13847372 | 2669 | -14.A.C;86.-.C | 0.597 | 0.440 |
| 2654872 | 2670 | 0.T.-;2.A.C;75.C.A | 0.596 | 0.361 |
| 8543875 | 2671 | 75.-.G;89.A.G | 0.596 | 0.481 |
| 8150315 | 2672 | 77.-.A;131.A.C | 0.595 | 0.217 |
| 13854171 | 2673 | -14.A.C;74.-.T | 0.595 | 0.255 |
| 8084187 | 2674 | 74.-.G;132.G.T | 0.595 | 0.378 |
| 1249988 | 2675 | -15.T.G;86.C.- | 0.594 | 0.264 |
| 10308807 | 2676 | 17.-.T;78.A.-;80.A.- | 0.593 | 0.538 |
| 8093276 | 2677 | 75.-.A;130.T.G | 0.593 | 0.294 |
| 15069677 | 2678 | -29.A.G;0.T.-;2.A.G;75.-.G | 0.593 | 0.429 |
| 2884699 | 2679 | 1.-.C;77.-.A | 0.593 | 0.444 |
| 14921605 | 2680 | -29.A.C;2.A.-;74.-.T | 0.592 | 0.536 |
| 8448153 | 2681 | 80.A.-;132.G.C | 0.592 | 0.175 |
| 8140966 | 2682 | 76.G.-;118.T.C | 0.591 | 0.209 |
| 8161140 | 2683 | 79.G.-;132.G.C | 0.591 | 0.221 |
| 15165008 | 2684 | -29.A.G;88.-.T | 0.590 | 0.294 |
| 15058006 | 2685 | -29.A.G;0.T.-;2.A.C;76.GG.-A | 0.590 | 0.449 |
| 14647360 | 2686 | -29.A.C;0.T.-;2.A.C;75.CG.-T | 0.589 | 0.365 |
| 8207947 | 2687 | 88.G.-;129.C.A | 0.588 | 0.254 |
| 2684707 | 2688 | 0.T.-;2.A.C;129.C.G | 0.587 | 0.249 |
| 12177699 | 2689 | 2.A.-82.A.-;84.A.T | 0.587 | 0.578 |
| 8495115 | 2690 | 76.-.G;80.A.G | 0.587 | 0.277 |
| 8173741 | 2691 | 77.GA.---;126.C.A | 0.586 | 0.262 |
| 8044380 | 2692 | 72.-.G;87.-.G | 0.586 | 0.496 |
| 2270366 | 2693 | 0.T.-;120.C.A. | 0.585 | 0.348 |
| 15456767 | 2694 | -30.C.G;74.-.T | 0.585 | 0.259 |
| 12752882 | 2695 | 0.-.T;73.AT.-G | 0.584 | 0.561 |
| 4217308 | 2696 | 4.T.-;71.T.C | 0.584 | 0.515 |
| 14810890 | 2697 | -29.A.C;78.AG.-C | 0.583 | 0.368 |
| 13853442 | 2698 | -14.A.C;76.GG.-T | 0.583 | 0.211 |
| 8448176 | 2699 | 80.A.- | 0.583 | 0.209 |
| 8103057 | 2700 | 76.GG.-A;98.-.A | 0.582 | 0.554 |
| 8141130 | 2701 | 76.G.-;118.T.G | 0.581 | 0.262 |
| 8133120 | 2702 | 75.-.C;86.-.G | 0.581 | 0.269 |
| 14921140 | 2703 | -29.A.C;2.A.-;76.-.G | 0.581 | 0.464 |
| 1046627 | 2704 | -17.C.A;74.-.T | 0.581 | 0.238 |
| 8490817 | 2705 | 76.-.G;122.A.C | 0.581 | 0.338 |
| 2749021 | 2706 | 0.T.-;2.A.C;65.G.T | 0.581 | 0.520 |
| 1251730 | 2707 | -15.T.G;78.-.C | 0.580 | 0.278 |
| 8565400 | 2708 | 75.CG.-T;131.AG.CC | 0.580 | 0.163 |
| 8034315 | 2709 | 72.-.C;87.-.G | 0.580 | 0.400 |
| 1095467 | 2710 | -16.C.A;0.T.-;2.A.C | 0.578 | 0.254 |
| 1982142 | 2711 | 0.T.C;70.-.T | 0.578 | 0.515 |
| 2661968 | 2712 | 0.T.-;2.A.C;76.G.-;133.A.C | 0.577 | 0.442 |
| 14529775 | 2713 | -28.G.T;75.-.G | 0.577 | 0.358 |

TABLE 4-continued

Median Enrichment of DME Scaffold Variants

| index | SEQ ID NO | muts_lindexed | MI | 95% CI |
|---|---|---|---|---|
| 2464540 | 2714 | 0.T.-;3.C.-;82.AA.-- | 0.576 | 0.497 |
| 3011533 | 2715 | 1.TA.--;126.C.A | 0.576 | 0.386 |
| 8160673 | 2716 | 79.G.-;121.C.A | 0.576 | 0.277 |
| 445036 | 2717 | -27.C.A;87.-.T | 0.576 | 0.386 |
| 8480668 | 2718 | 78.A.-;130.T.C | 0.576 | 0.239 |
| 446329 | 2719 | -27.C.A;78.-.C | 0.576 | 0.276 |
| 8524684 | 2720 | 76.-.T;86.-.C | 0.575 | 0.428 |
| 14350148 | 2721 | -25.A.C;78.A.- | 0.575 | 0.252 |
| 15456629 | 2722 | -30.C.G;75.C.- | 0.575 | 0.433 |
| 8084175 | 2723 | 74.-.G;133.A.C | 0.574 | 0.498 |
| 8470281 | 2724 | 78.-.C;133.A.C | 0.574 | 0.327 |
| 1976159 | 2725 | 0.T.C;88.G.- | 0.573 | 0.487 |
| 2553815 | 2726 | 0.T.-;2.A.C;11.T.C | 0.573 | 0.381 |
| 856531;3 | 2727 | 75.CG.-T;130.T.G | 0.573 | 0.285 |
| 8142626 | 2728 | 76.G.-128.T.C | 0.573 | 0.271 |
| 15059444 | 2729 | -29.A.G;0.T.-;2.A.C;76.GG.-T | 0.571 | 0.539 |
| 14349990 | 2730 | -25.A.C;78.-.C | 0.570 | 0.340 |
| 7944404 | 2731 | 66.CT.-A;86.-.C | 0.570 | 0.517 |
| 8143508 | 2732 | 76.G.-;122.A.G | 0.570 | 0.295 |
| 8483736 | 2733 | 78.A.-;99.-.G | 0.570 | 0.383 |
| 8457128 | 2734 | 80.AG.-T | 0.570 | 0.408 |
| 14685680 | 2735 | -29.A.C;4.T.-;76.GG.-C | 0.570 | 0.468 |
| 8639135 | 2736 | 66.CT.-G;75.-.G | 0.570 | 0.439 |
| 8093196 | 2737 | 75.-.A;128.T.G | 0.570 | 0.286 |
| 2574670 | 2738 | 0.T.-;2.A.C;21.T.A | 0.569 | 0.278 |
| 2270511 | 2739 | 0.T.-;121.C.A | 0.569 | 0.347 |
| 2411434 | 2740 | 1.-.A;78.A.- | 0.568 | 0.492 |
| 8128649 | 2741 | 75.-.C;131.A.C;133.A.C | 0.568 | 0.311 |
| 2837903 | 2742 | 2.A.C;0.T.-;5.G.T | 0.567 | 0.302 |
| 15456872 | 2743 | -30.C.G;75.CG.-T | 0.567 | 0.275 |
| 2684575 | 2744 | 130.--T.TAG;133.A.G;2.A.C;0.T.- | 0.567 | 0.297 |
| 15486653 | 2745 | -30.C.G;2.A.- | 0.567 | 0.457 |
| 12202811 | 2746 | 2.A.-;75.-.G;133.A.C | 0.566 | 0.396 |
| 8480879 | 2747 | 78.A.-;129.C.G | 0.566 | 0.324 |
| 3011188 | 2748 | 1.TA.--;121.C.A | 0.564 | 0.372 |
| 8297879 | 2749 | 99.-.G | 0.563 | 0.268 |
| 8352639 | 2750 | 86.C.-;127.T.G | 0.563 | 0.202 |
| 14801514 | 2751 | -29.A.C;86.-.A | 0.562 | 0.474 |
| 1975537 | 2752 | 0.T.C;79.G.- | 0.562 | 0.486 |
| 8480783 | 2753 | 78.A.-;134.G.T | 0.561 | 0.409 |
| 14351204 | 2754 | -25.A.C;75.C.- | 0.561 | 0.404 |
| 1042672 | 2755 | -17.C.A;87.-.A | 0.560 | 0.387 |
| 8480385 | 2756 | 78.A.-;126.C.A | 0.560 | 0.238 |
| 8105496 | 2757 | 76.GG.-A;127.T.G | 0.559 | 0.269 |
| 15059173 | 2758 | -29.A.G;0.T.-;2.A.C;80.A.- | 0.558 | 0.364 |
| 8132470 | 2759 | 75.-.C;91.AA.-G | 0.558 | 0.468 |
| 14663399 | 2760 | -29.A.C;0.T.-;2.A.G;75.C.- | 0.556 | 0.453 |
| 8132353 | 2761 | 75.-.C;91.A.-;93.A.G | 0.556 | 0.392 |
| 6557204 | 2762 | 18.C.A;78.A- | 0.555 | 0.330 |
| 13845080 | 2763 | -14.A.C;75.-.A | 0.554 | 0.281 |
| 2894429 | 2764 | 1.-.C;86.-.G | 0.554 | 0.356 |
| 8605594 | 2765 | 73.A.-;87.-.T | 0.553 | 0.323 |
| 14918668 | 2766 | -29.C;2.A.-;75.-.A | 0.553 | 0.285 |
| 13852859 | 2767 | -14.A.C;76.-.G | 0.553 | 0.304 |
| 8558273 | 2768 | 74.-.T;126.C.A | 0.553 | 0.203 |
| 14344734 | 2769 | -25.A.C;76.GG.-C | 0.552 | 0.425 |
| 8063226 | 2770 | 74.T.-;87.-.A | 0.552 | 0.355 |
| 8564564 | 2771 | 75.CG.-T;119.C.A | 0.552 | 0.230 |
| 13687669 | 2772 | -12.G.T;75.-.G | 0.551 | 0.378 |
| 14812439 | 2773 | -29.A.C;78.A.T | 0.551 | 0.502 |
| 7944045 | 2774 | 66.CT.-A;76.G.- | 0.551 | 0.426 |
| 2685752 | 2775 | 0.T.-;2.A.C;119.C.T | 0.549 | 0.206 |
| 8118242 | 2776 | 130.--T.TAG;133.A.G;76.GG.-C | 0.549 | 0.423 |
| 1245577 | 2777 | -15.T.G;73.-.A | 0.549 | 0.539 |
| 15454032 | 2778 | -30.C.G;86.C.- | 0.548 | 0.147 |
| 15738375 | 2779 | -32.G.T;75.-.G | 0.548 | 0.300 |
| 6302341 | 2780 | 16.-.A;72.-.C | 0.548 | 0.363 |
| 2287278 | 2781 | 0.T.-;82.-.T | 0.548 | 0.435 |
| 3599083 | 2782 | 2.-.A;78.-.C | 0.548 | 0.398 |
| 8538303 | 2783 | 75.-.G;129.C.G | 0.547 | 0.446 |
| 3025181 | 2784 | 1.TA.--;82.-.T | 0.546 | 0.498 |
| 999582 | 2785 | -17.C.A;0.T.- | 0.546 | 0.407 |
| 9986114 | 2786 | 19.-.G;89.-.C | 0.546 | 0.492 |
| 13096860 | 2787 | -1.GT.--;74.T.- | 0.545 | 0.126 |
| 14686894 | 2788 | -29.A.C;4.T.-;86.C.- | 0.545 | 0.410 |
| 8515608 | 2789 | 76.G.-;78.AG.TT | 0.545 | 0.313 |
| 10071761 | 2790 | 19.-.T;85.TC.-A | 0.545 | 0.528 |
| 8540169 | 2791 | 75.-.G;113.A.G | 0.543 | 0.381 |
| 15170520 | 2792 | -29.A.G;73.AT.-G | 0.543 | 0.302 |
| 8133499 | 2793 | 75.-.C;83.-.G | 0.542 | 0.398 |
| 15161304 | 2794 | -29.A.G;76.G.-;78.A.C | 0.542 | 0.361 |
| 14815543 | 2795 | -29.A.C;73.AT.-G | 0.542 | 0.269 |
| 14812304 | 2796 | -29.A.C;78.-.T | 0.542 | 0.456 |
| 8351219 | 2797 | 86.C.-;115.T.G | 0.542 | 0.167 |
| 8363173 | 2798 | 87.-.T;129.C.A | 0.542 | 0.455 |
| 8128504 | 2799 | 75.-.C;130.T.C | 0.542 | 0.301 |
| 8538167 | 2800 | 75.-.G;132.GA.CC | 0.541 | 0.416 |
| 8063302 | 2801 | 74.T.-;88.G.- | 0.541 | 0.307 |
| 10087553 | 2802 | 19.-.T;78.A.-;80.A.- | 0.541 | 0.496 |
| 7490687 | 2803 | 36.C.A;76.G.- | 0.540 | 0.153 |
| 8202465 | 2804 | 87.-.A;132.G.T | 0.540 | 0.577 |
| 8519530 | 2805 | 76.GG.-T;131.AG.CC | 0.540 | 0.199 |
| 4321331 | 2806 | 4.T.-;65.G.T | 0.539 | 0.513 |
| 15239627 | 2807 | -29.A.G;2.A.-;75.-.C | 0.539 | 0.394 |
| 14808642 | 2808 | -29.A.C;82.A.-;84.A.T | 0.539 | 0.494 |
| 12123800 | 2809 | 2.A.-76.G.-;133.A.C | 0.539 | 0.365 |
| 15169507 | 2810 | -29.A.G;75.C.- | 0.539 | 0.410 |
| 2731526 | 2811 | 0.T.-;2.A.C;75.-.G;132.G.T | 0.538 | 0.518 |
| 8118032 | 2812 | 76.GG.-C;127.T.G | 0.537 | 0.352 |
| 15168665 | 2813 | -29.A.G;77.-.T | 0.537 | 0.501 |
| 8546114 | 2814 | 75.C.-;88.G.- | 0.537 | 0.433 |
| 6480287 | 2815 | 16.-.C;73.A.G | 0.536 | 0.477 |
| 8367284 | 2816 | 86.-.G;121.C.A | 0.535 | 0.179 |
| 14245829 | 2817 | -24.G.T;78.A.- | 0.535 | 0.289 |
| 8526318 | 2818 | 76.-.T;121.C.A | 0.535 | 0.258 |
| 320895 | 2819 | -28.G.C;75.-.G | 0.534 | 0.339 |
| 14801003 | 2820 | -29.A.C;85.TC.-A | 0.534 | 0.427 |
| 2900348 | 2821 | 1.-.C;76.G.-;78.A.T | 0.534 | 0.476 |
| 8173897 | 2822 | 77.GA.--;129.C.A | 0.533 | 0.287 |
| 10315449 | 2823 | 17.-.T;73.A.G | 0.533 | 0.462 |
| 8118283 | 2824 | 76.GG.-C;131.AG.CC | 0.532 | 0.507 |
| 8638120 | 2825 | 66.CT.-G;81.GA.-T | 0.530 | 0.190 |
| 8115215 | 2826 | 76.GG.-C;98.-.A | 0.530 | 0.407 |
| 8098639 | 2827 | 75.CG.-A | 0.528 | 0.398 |
| 8363276 | 2828 | 87.-.T;133.A.C | 0.528 | 0.445 |
| 8490333 | 2829 | 76.-.G;130.T.G | 0.527 | 0.344 |
| 670332 | 2830 | -23.C.A;76.G.- | 0.527 | 0.335 |
| 14499926 | 2831 | -28.G.T;0.T.-;2.A.C | 0.526 | 0.192 |
| 8357643 | 2832 | 87.-.G;127.T.G | 0.526 | 0.313 |
| 4269759 | 2833 | 4.T.-;91.A.-;93.A.G | 0.526 | 0.367 |
| 8145628 | 2834 | 76.G.-;113.A.G | 0.526 | 0.317 |
| 1250781 | 2835 | -15.T.G;86.-.G | 0.525 | 0.171 |
| 2684458 | 2836 | 0.T.-;2.A.C;130.T.C | 0.525 | 0.230 |
| 8211364 | 2837 | 86.-.C;115.T.G | 0.524 | 0.484 |
| 12327615 | 2838 | 2.A.-;6.G.T | 0.524 | 0.498 |
| 13750639 | 2839 | -13.G.T;76.GG.-T | 0.524 | 0.200 |
| 8545256 | 2840 | 75.-.G;82.AA.-T | 0.524 | 0.311 |
| 15051403 | 2841 | -29.A.G;0.T.-;76.G- | 0.523 | 0.359 |
| 8128996 | 2842 | 75.-.C;122.A.C | 0.523 | 0.296 |
| 15157689 | 2843 | -29.A.G;72.-.A | 0.523 | 0.391 |
| 3011885 | 2844 | 1.TA.--;131.A.C | 0.522 | 0.413 |
| 6586124 | 2845 | 18.-.A;73.AT.-C | 0.572 | 0.393 |
| 8538269 | 2846 | 75.-.G;.131.A.G | 0.522 | 0.380 |
| 2661660 | 2847 | 0.T.-;2.A.C;76.G.-;121.C.A | 0.521 | 0.429 |
| 8490491 | 2848 | 76.-.G;131.A.G | 0.520 | 0.268 |
| 8638542 | 2849 | 66.CT.-G;78.-.C | 0.520 | 0.367 |
| 14230312 | 2850 | -24.G.T;0.T.-;2.A.C | 0.520 | 0.346 |
| 6554102 | 2851 | 18.C.A;76.GG.-A | 0.519 | 0.207 |
| 8480490 | 2852 | 78.A.-;127.T.G | 0.519 | 0.216 |
| 12148735 | 2853 | 2.A.-;127.TG | 0.519 | 0.454 |
| 6554952 | 2854 | 18.C.A;86.-.C | 0.519 | 0.411 |
| 8548546 | 2855 | 75.C.-;119.C.A | 0.518 | 0.375 |
| 8537738 | 2856 | 75.-.G;125.T.G | 0.518 | 0.422 |
| 14524986 | 2857 | -28.G.T;76.G.- | 0.517 | 0.211 |
| 8112028 | 2858 | 76.-.A;121.C.A | 0.517 | 0.479 |
| 8558469 | 2859 | 74.-.T;130.T.G | 0.517 | 0.240 |
| 8536730 | 2860 | 75.-.G;118.T.G | 0.517 | 0.347 |
| 1975405 | 2861 | 0.T.C;77.-.A | 0.516 | 0.381 |

TABLE 4-continued

Median Enrichment of DME Scaffold Variants

| index | SEQ ID NO | muts_lindexed | MI | 95% CI |
|---|---|---|---|---|
| 8490677 | 2862 | 76.-.G;123.A.C | 0.516 | 0.355 |
| 14351455 | 2863 | -25.A.C;75.CG.-T | 0.515 | 0.304 |
| 8519708 | 2864 | 76.GG.-T;123.A.C | 0.515 | 0.222 |
| 13850181 | 2865 | -14.A.C;86.C.- | 0.515 | 0.175 |
| 829963 | 2866 | -21.C.A;76.GG.-T | 0.513 | 0.195 |
| 396157 | 2867 | -27.C.A;1.TA.-- | 0.512 | 0.411 |
| 8128583 | 2868 | 130.--T.TAG;133.A.G;75.-.C | 0.511 | 0.327 |
| 3011846 | 2869 | 1TA.--;133.A.C | 0.511 | 0.352 |
| 14918900 | 2870 | -29.A.C;2.A.-;75.-.C | 0.510 | 0.475 |
| 15159253 | 2871 | -29.A.G;74.-.C | 0.509 | 0.438 |
| 8480820 | 2872 | 78.A.-;131.A.G.CC | 0.509 | 0.277 |
| 2824789 | 2873 | 0.T.-;2.A.C;16.C.- | 0.508 | 0.431 |
| 8030574 | 2874 | 72.-.C;88.G.- | 0.507 | 0.293 |
| 8103971 | 2875 | 76.GG.-A;115.T.G | 0.507 | 0.334 |
| 8480769 | 2876 | 130.--T.TAG;133.A.G;78.A.- | 0.507 | 0.276 |
| 12146846 | 2877 | 2.A.-;118.T.C | 0.507 | 0.448 |
| 8105632 | 2878 | 76.GG.-A;130.T.G | 0.507 | 0.318 |
| 14655186 | 2879 | -29.A.C;1.TA.--;78.A.- | 0.505 | 0.350 |
| 13887801 | 2880 | -14.A.C;2.A.- | 0.505 | 0.417 |
| 8558448 | 2881 | 74.-.T;130.T.C | 0.504 | 0.275 |
| 8588552 | 2882 | 73.AT.-G;87.-.G | 0.503 | 0.383 |
| 4277297 | 2883 | 4.T.-;86.C.T | 0.503 | 0.317 |
| 8490414 | 2884 | 130.--T.TAG;133.A.G;76.-.G | 0.502 | 0.266 |
| 8557082 | 2885 | 74.-.T;115.T.G | 0.502 | 0.240 |
| 3010886 | 2886 | 1.TA.--;119.C.A | 0.502 | 0.332 |
| 8123134 | 2887 | 75.-.C;82.-.A | 0.501 | 0.402 |
| 8558564 | 2888 | 74.-.T;131.AG.CC | 0.501 | 0.241 |
| 10570905 | 2889 | 15.-.T;66.C.- | 0.500 | 0.475 |
| 8448232 | 2890 | 80.A.-;131.A.C | 0.499 | 0.207 |
| 1041390 | 2891 | -17.C.A;75.-.A | 0.499 | 0.324 |
| 646656 | 2892 | -23.C.A;0.T.-;2.A.C | 0.499 | 0.258 |
| 15167125 | 2893 | -29.A.G;80.A.- | 0.499 | 0.246 |
| 8105551 | 2894 | 76.GG.-A;128.T.G | 0.498 | 0.268 |
| 8084057 | 2895 | 74.-.G;129.C.A | 0.495 | 0.351 |
| 8493858 | 2896 | 76.-.G;91.A.- | 0.495 | 0.442 |
| 10544166 | 2897 | 15.-.T;91.A.-;93.A.G | 0.495 | 0.361 |
| 8565224 | 2898 | 75.CG.-T;128.T.G | 0.494 | 0.258 |
| 8586274 | 2899 | 73.AT.-G;131.A.C | 0.494 | 0.326 |
| 8362865 | 2900 | 87.-.T;121.C.A | 0.494 | 0.439 |
| 443254 | 2901 | -27.C.A;88.G.- | 0.493 | 0.161 |
| 13171639 | 2902 | -1.G.T;75.-.G | 0.493 | 0.492 |
| 8478628 | 2903 | 78.A.-;116.T.G | 0.492 | 0.261 |
| 6557301 | 2904 | 18.C.A;76.-.G | 0.492 | 0.407 |
| 8752532 | 2905 | 55.-.T;75.-.A | 0.491 | 0.445 |
| 8560929 | 2906 | 74.-.T;91.A.-;93.A.G | 0.491 | 0.384 |
| 4295718 | 2907 | 4.T.-;78.A.-;132.G.C | 0.491 | 0.428 |
| 10561864 | 2908 | 15.-.T;76.G.T | 0.491 | 0.343 |
| 8537677 | 2909 | 75.-.G;125.T.C | 0.490 | 0.274 |
| 8143025 | 2910 | 76.G.-;129.C.G | 0.489 | 0.328 |
| 80936 | 2911 | 75.-.A;89.-.A | 0.489 | 0.373 |
| 8599794 | 2912 | 70.-.T;76.-.G | 0.489 | 0.391 |
| 8105873 | 2913 | 76.GG.-A;123.A.C | 0.488 | 0.222 |
| 8517616 | 2914 | 76.GG.-T;115.T.G | 0.487 | 0.198 |
| 1214710 | 2915 | 2.A.-;122.A.C | 0.486 | 0.445 |
| 8489904 | 2916 | 76.-.G;124.T.G | 0.486 | 0.230 |
| 1164547 | 2917 | -15.T.C;76.G.- | 0.485 | 0.304 |
| 8653886 | 2918 | 65.GC.-T;87.-.G | 0.485 | 0.239 |
| 8074762 | 2919 | 74.-.C;86.C.- | 0.485 | 0.342 |
| 8480183 | 2920 | 78.A.-;124.T.G | 0.485 | 0.156 |
| 14921899 | 2921 | -29.A.C;2.A.-;73.A.- | 0.485 | 0.412 |
| 806417 | 2922 | -21.C.A;0.T.-;2.A.C | 0.485 | 0.214 |
| 8367608 | 2923 | 86.-.G;132.G.T | 0.484 | 0.200 |
| 3000591 | 2924 | 1.TA.--;76.G.-;132.G.C | 0.484 | 0.411 |
| 8692683 | 2925 | 73.A.-121.C.A | 0.483 | 0.181 |
| 1250113 | 2926 | -15.T.G;87.-.T | 0.483 | 0.353 |
| 1246020 | 2927 | -15.T.G;74.-.G | 0.483 | 0.468 |
| 8095244 | 2928 | 75.-.A;99.-.G | 0.482 | 0.441 |
| 7516650 | 2929 | 38.C.A;75.-.G | 0.482 | 0.232 |
| 8101468 | 2930 | 75.C.A;78.A.- | 0.482 | 0.243 |
| 6420798 | 2931 | 17.T.C;76.G.- | 0.481 | 0.123 |
| 8080536 | 2932 | 74.-.G;88.G.- | 0.481 | 0.304 |
| 8583631 | 2933 | 73.AT.-G;86.-.C | 0.481 | 0.328 |
| 2685339 | 2934 | 0.T.-;2.A.C;121.C.T | 0.480 | 0.259 |
| 15241190 | 2935 | -29.A.G;2.A.-;76.GG.-T | 0.480 | 0.448 |
| 4235216 | 2936 | 4.T.-;77.G.A | 0.480 | 0.358 |
| 333335 | 2937 | 2.A.-;-28.G.C | 0.479 | 0.437 |
| 15454091 | 2938 | -30.C.G;87.-.G | 0.479 | 0.245 |
| 8104903 | 2939 | 76.GG.-A;119.C.A | 0.478 | 0.291 |
| 14795119 | 2940 | -29.A.C;72.-.C | 0.478 | 0.366 |
| 8549156 | 2941 | 126.C.A;75.C.- | 0.478 | 0.401 |
| 2270186 | 2942 | 0.T.-;119.C.A | 0.476 | 0.290 |
| 442714 | 2943 | -27.C.A;79.G.- | 0.476 | 0.336 |
| 2684191 | 2944 | 0.T.-;2.A.C;127.T.C | 9.476 | 0.231 |
| 2661980 | 2945 | 0.T.-;2.A.C;76.G.-;132.G.T | 0.476 | 0.461 |
| 8759441 | 2946 | 55.-.T;75.CG.-T | 0.475 | 0.311 |
| 8548730 | 2947 | 75.C.-;120.C.A | 0.475 | 0.390 |
| 2517486 | 2948 | 1.T.C;75.CG.-T | 0.475 | 0.383 |
| 13098412 | 2949 | -1.GT.--;86.-.C | 0.474 | 0.202 |
| 6556251 | 2950 | 18.C.A;87.-.G | 0.471 | 0.229 |
| 8539383 | 2951 | 75.-.G;117.G.T | 0.470 | 0.351 |
| 2728400 | 2952 | 0.T.-;2.A.C;76.GG.-T;132.G.T | 0.469 | 0.458 |
| 8147743 | 2953 | 76.G.-89.-.C | 0.469 | 0.171 |
| 8538151 | 2954 | 75.-.G;132.G.A | 0.467 | 0.349 |
| 8519808 | 2955 | 76.GG.-T;122.A.C | 0.467 | 0.179 |
| 8538739 | 2956 | 75.-.G;122.A.G | 0.467 | 0.335 |
| 8055399 | 2957 | 73.-.A;88.G.- | 0.466 | 0.320 |
| 8602922 | 2958 | 73.A.-;126.C.A | 0.466 | 0.283 |
| 8558390 | 2959 | 74.-.T;128.T.G | 9.465 | 0.206 |
| 8202371 | 2960 | 87.-.A;129.C.A | 0.465 | 0.465 |
| 8495023 | 2961 | 78.A.-;82.A.G | 0.463 | 0.212 |
| 8093252 | 2962 | 75.-.A;130.T.C | 0.463 | 0.335 |
| 2566367 | 2963 | 0.T.-;2.A.C;17.T.C | 0.461 | 0.268 |
| 443194 | 2964 | -27.C.A;87.-.A | 0.461 | 0.399 |
| 8586216 | 2965 | 73.AT.-G;132.G.C | 0.461 | 0.251 |
| 8492129 | 2966 | 76.-.G;113.A.G | 0.460 | 0.274 |
| 8602593 | 2967 | 73.A.-120.C.A | 0.460 | 0.167 |
| 12438314 | 2968 | 1.TAC.---;76.-.T | 9.459 | 0.409 |
| 8018666 | 2969 | 72.-.A;131.A.C | 0.459 | 0.406 |
| 2658141 | 2970 | 0.T.-;2.A.C;76.GG.-C;132.G.C | 0.459 | 0.418 |
| 2270855 | 2971 | 0.T.-;126.C.A | 0.458 | 0.340 |
| 3011771 | 2972 | 1.TA.--;129.C.A | 0.458 | 0.369 |
| 8357785 | 2973 | 87.-.G;130.T.G | 0.457 | 0.321 |
| 12148855 | 2974 | 2.A.-;128.T.G | 0.457 | 0.424 |
| 8538425 | 2975 | 75.-.G;126.C.T | 0.456 | 0.392 |
| 14812176 | 2976 | -29.A.C;78.AG.-T | 0.455 | 0.422 |
| 959345 | 2977 | -18.T.G;0.T.-;2.A.C | 0.455 | 0.263 |
| 8352569 | 2978 | 86.C.-;126.C.A | 0.452 | 0.232 |
| 8562579 | 2979 | 75.CG.-T;86.-.C | 0.452 | 0.285 |
| 12185250 | 2980 | 2.A.-;80.A.-;132.G.C | 0.452 | 0.397 |
| 8118567 | 2981 | 76.GG.-C;122.A.C | 0.449 | 0.341 |
| 8129443 | 2982 | 75.-.C;119.C.T | 0.448 | 0.241 |
| 8488242 | 2983 | 76.-.G;115.T.G | 0.448 | 0.303 |
| 2685947 | 2984 | 0.T.-;2.A.C;117.G.T | 0.447 | 0.224 |
| 2684042 | 2985 | 0.T.-;2.A.C;125.T.G | 0.446 | 0.225 |
| 2628011 | 2986 | 0.T.-;2.A.C;65.G.A | 0.446 | 0.431 |
| 1093922 | 2987 | -16.C.A;0.T.- | 0.446 | 0.385 |
| 14021392 | 2988 | -19.G.T;76.G.- | 0.445 | 0.211 |
| 14023783 | 2989 | -19.G.T;75.-.G | 0.445 | 0.321 |
| 8479108 | 2990 | 118.T.C;78.A.- | 0.444 | 0.180 |
| 4295742 | 2991 | 4.T.-;78.A.-;132.G.T | 0.444 | 0.342 |
| 8348822 | 2992 | 88.-.T;132.G.C | 0.444 | 0.307 |
| 8448431 | 2993 | 80.A.-;128.T.G | 0.443 | 0.216 |
| 8480854 | 2994 | 78.A.-131.A.G | 0.442 | 0.339 |
| 8073282 | 2995 | 74.-.C;133.A.c | 0.442 | 0.352 |
| 2271058 | 2996 | 129.C.A;0.T.- | 0.442 | 0.317 |
| 12151722 | 2997 | 2.A.-;113.A.C | 0.441 | 0.449 |
| 13168765 | 2998 | -1.G.T;76.G.- | 0.440 | 0.238 |
| 8760885 | 2999 | 56.G.T;76.G.- | 0.439 | 0.164 |
| 8518019 | 3000 | 76.GG.-T;116.T.G | 0.438 | 0.236 |
| 1117025 | 3001 | -16.C.A;78.A.- | 0.438 | 0.168 |
| 8592769 | 3002 | 70.-.T;88.G.- | 0.438 | 0.245 |
| 8628663 | 3003 | 66.CT.-G;79.G.- | 0.438 | 0.183 |
| 8480752 | 3004 | 78.A.-;132.GA.CC | 0.438 | 0.249 |
| 8059585 | 3005 | 73.-.A;86.C.- | 0.437 | 0.436 |
| 13750261 | 3006 | -13.G.T;78.A.- | 0.437 | 0.253 |
| 8539599 | 3007 | 75.-.G;114.G.T | 0.437 | 0.374 |
| 8352028 | 3008 | 86.C.-;119.C.A | 0.436 | 0.189 |
| 8129947 | 3009 | 75.-.C;113.A.C | 0.436 | 0.305 |
| 8538081 | 3010 | 75.-.G;130.T.C;132.G.C | 0.435 | 0.332 |

TABLE 4-continued

Median Enrichment of DME Scaffold Variants

| index | SEQ ID NO | muts_lindexed | MI | 95% CI |
|---|---|---|---|---|
| 8561460 | 3011 | 74.-.T;86.-.G | 0.433 | 0.233 |
| 8363222 | 3012 | 87.-.T;130.T.G | 0.432 | 0.345 |
| 15749286 | 3013 | -32.G.T;2.A.- | 0.431 | 0.390 |
| 8129269 | 3014 | 75.-.C;120.C.T | 0.431 | 0.274 |
| 445858 | 3015 | -27.C.A;82.AA.-T | 0.431 | 0.234 |
| 8133915 | 3016 | 75.-.C;80.A.G | 0.431 | 0.344 |
| 1045161 | 3017 | -17.C.A;82.AA.-T | 0.430 | 0.182 |
| 2569551 | 3018 | 0.T.-;2.A.C;18.C.A | 0.430 | 0.278 |
| 8034268 | 3019 | 72.-.C;86.C.- | 0.428 | 0.226 |
| 481315 | 3020 | -27.C.A;2.A.-;76.G.- | 0.428 | 0.366 |
| 447361 | 3021 | -27.C.A;75.C.- | 0.427 | 0.372 |
| 393117 | 3022 | -27.C.A;0.T.-;2.A.C;76.G.- | 0.427 | 0.380 |
| 672550 | 3023 | -23.C.A;76.GG.-T | 0.427 | 0.135 |
| 13171223 | 3024 | -1.G.T;78.A.- | 0.427 | 0.170 |
| 2269114 | 3025 | 0.T.-;115.T.G | 0.424 | 0.334 |
| 15164765 | 3026 | -29.A.G;89.-.C | 0.424 | 0.193 |
| 8150288 | 3027 | 77.-.A;133.A.C | 0.424 | 0.252 |
| 13716962 | 3028 | -13.G.T;0.T.-;2.A.C | 0.423 | 0.207 |
| 14810153 | 3029 | -29.A.C;80.A.- | 0.423 | 0.207 |
| 8149925 | 3030 | 77.-.A;121.C.A | 0.422 | 0.192 |
| 8118444 | 3031 | 76.GG.-C;123.A.C | 0.422 | 0.264 |
| 15450237 | 3032 | -30.C.G;74.T.- | 0.422 | 0.306 |
| 13847292 | 3033 | -14.A.C;88.G.- | 0.421 | 0.123 |
| 8599283 | 3034 | 70.-.T;82.AA.-G | 0.420 | 0.309 |
| 2258810 | 3035 | 0.T.-;76.G.-;132.G.C | 0.420 | 0.381 |
| 8352862 | 3036 | 86.C.-;131.AG.CC | 0.420 | 0.340 |
| 8431466 | 3037 | 82.AA.-T;121.C.A | 0.418 | 0.209 |
| 10604385 | 3038 | 16.C.T;76.GG.-C | 0.418 | 0.310 |
| 15410869 | 3039 | -30.C.G;1.TA.-- | 0.418 | 0.357 |
| 14644576 | 3040 | -29.A.C;0.T.-;2.A.C;74.T.- | 0.417 | 0.398 |
| 8174011 | 3041 | 77.GA.--;133.A.C | 0.416 | 0.330 |
| 13750370 | 3042 | -13.G.T;76.-.G | 0.416 | 0.250 |
| 8083409 | 3043 | 74.-.G;119.C.A | 0.416 | 0.376 |
| 8093325 | 3044 | 130.--T.TAG;133.A.G;75.-.A | 0.415 | 0.287 |
| 7740425 | 3045 | 51.C.A;75.-.G | 0.414 | 0.309 |
| 2271544 | 3046 | 0.T.-;122.A.C | 0.413 | 0.314 |
| 8154715 | 3047 | 76.G.-;78.A.C;132.G.T | 0.413 | 0.330 |
| 2684548 | 3048 | 0.T.-;2.A.C;132.GA.CC | 0.413 | 0.221 |
| 1042081 | 3049 | -17.C.A;77.-.A | 0.412 | 0.147 |
| 14808586 | 3050 | -29.A.C;82.AA.-- | 0.412 | 0.268 |
| 8106752 | 3051 | 76.GG.-A;113.A.C | 0.412 | 0.273 |
| 8447956 | 3052 | 80.A.-;127.T.G | 0.411 | 0.234 |
| 8128664 | 3053 | 75.-.C;131.A.G | 0.410 | 0.338 |
| 1291175 | 3054 | -15.T.G;2.A.-;75.-.G | 0.409 | 0.380 |
| 1253907 | 3055 | -15.T.G;73.A.- | 0.409 | 0.239 |
| 8128396 | 3056 | 128.T.C;75.-.C | 0.407 | 0.252 |
| 14084593 | 3057 | -20.A.C;75.-.G | 0.406 | 0.340 |
| 2661890 | 3058 | 0.T.-;2.A.C;76.G.-;129.C.A | 0.406 | 0.359 |
| 8598917 | 3059 | 70.-.T;82.A.- | 0.406 | 0.363 |
| 8519493 | 3060 | 130.--T.TAG;133.A.G;76.GG.-T | 0.405 | 0.165 |
| 2655861 | 3061 | 0.T.-;2.A.C;76.GG.-A;132.G.C | 0.404 | 0.211 |
| 8554353 | 3062 | 74.-.C.TA | 0.404 | 0.279 |
| 6557545 | 3063 | 18.C.A;76.GG.-T | 0.404 | 0.249 |
| 1247115 | 3064 | -15.T.G;77.-.A | 0.403 | 0.162 |
| 15450484 | 3065 | -30.C.G;74.-.G | 0.402 | 0.369 |
| 8105724 | 3066 | 76.GG.-A;131.AG.CC | 0.401 | 0.312 |
| 14644689 | 3067 | -29.A.C;0.T.-;2.A.C;75.-.A | 0.401 | 0.381 |
| 8558610 | 3068 | 74.-.T;129.C.G | 0.400 | 0.216 |
| 8357449 | 3069 | 87.-.G;124.T.G | 0.400 | 0.280 |
| 15738093 | 3070 | -32.G.T;78.A.- | 0.400 | 0.179 |
| 8161146 | 3071 | 79.G.-;132.G.T | 0.399 | 0.197 |
| 827638 | 3072 | -21.C.A;76.GG-C | 0.399 | 0.381 |
| 14647317 | 3073 | -29.A.C;0.T.-;2.A.C;74.-.T | 0.399 | 0.337 |
| 8431948 | 3074 | 82.AA.-T;132.G.T | 0.396 | 0.283 |
| 14344384 | 3075 | -25.A.C;75.-.A | 0.396 | 0.313 |
| 8508448 | 3076 | 78.A.T;132.G.C | 0.395 | 0.355 |
| 8150265 | 3077 | 77.-.A;132.G.C | 0.395 | 0.232 |
| 8654330 | 3078 | 65.GC.-T;78.A.- | 0.395 | 0.294 |
| 8093514 | 3079 | 75.-.A;123.A.C | 0.394 | 0.309 |
| 8352775 | 3080 | 86.C.-;130.TG | 0.392 | 0.217 |
| 8066628 | 3081 | 74.T.-;130.T.G | 0.392 | 0.262 |
| 15168618 | 3082 | -29.A.G;76.G.-;78.A.T | 0.390 | 0.336 |
| 672344 | 3083 | -23.C.A;78.A.- | 0.390 | 0.322 |
| 8586257 | 3084 | 73.AT.-G;132.G.T | 0.388 | 0.296 |
| 8105301 | 3085 | 76.GG.-A;124.T.G | 0.388 | 0.288 |
| 8212901 | 3086 | 86.-.C;131.AG.CC | 0.386 | 0.353 |
| 13588657 | 3087 | -10.A.C;76.G.- | 0.385 | 0.348 |
| 728974 | 3088 | -22.T.A;75.-.G | 0.384 | 0.325 |
| 8448212 | 3089 | 80.A.-;132.G.T | 0.383 | 0.198 |
| 8128219 | 3090 | 75.-.C;125.T.G | 0.382 | 0.342 |
| 8084164 | 3091 | 130.--T.TAG;133.A.G;74.-.G | 0.381 | 0.324 |
| 13800992 | 3092 | -14.A.C;1.TA.-- | 0.381 | 0.380 |
| 8084111 | 3093 | 74.-.G;130.T.G | 0.380 | 0.285 |
| 14348272 | 3094 | -25.A.C;87.-.G | 0.376 | 0.227 |
| 8032114 | 3095 | 72.-.C;121.C.A | 0.375 | 0.317 |
| 8599500 | 3096 | 70.-.T;80.A.- | 0.375 | 0.307 |
| 14647476 | 3097 | -29.A.C;0.T.-;2.A.C;73.AT.-G | 0.375 | 0.287 |
| 8637349 | 3098 | 66.CT-G;82.A.- | 0.375 | 0.370 |
| 14059318 | 3099 | 2.A.C;0.T.-;-20.A.C | 0.374 | 0.261 |
| 5590089 | 3100 | 10.T.C;87.-.T | 0.373 | 0.345 |
| 8105685 | 3101 | 76.GG-A;130.--T.TAG;133.A.G | 0.372 | 0.233 |
| 2687214 | 3102 | 0.T.-;2.A.C;113.A.G | 0.371 | 0.260 |
| 8605752 | 3103 | 73.A.-;82.A.- | 0.369 | 0.345 |
| 8066727 | 3104 | 74.T.-;131.AG.CC | 0.367 | 0.285 |
| 872410 | 3105 | -21.C.-;76.G- | 0.366 | 0.282 |
| 13168625 | 3106 | -1.G.T;75.-.C | 0.366 | 0.326 |
| 442575 | 3107 | -27.C.A;77.-.A | 0.365 | 0.149 |
| 670080 | 3108 | -23.C.A;76.GG.-A | 0.365 | 0.229 |
| 2536818 | 3109 | 1.T.C;3.C.- | 0.365 | 0.278 |
| 15239473 | 3110 | -29.A.G;2.A.-;75.-.A | 0.364 | 0.308 |
| 8599361 | 3111 | 70.-.T;82.AA.-T | 0.364 | 0.203 |
| 8447558 | 3112 | 80.A.-;121.C.A | 0.364 | 0.190 |
| 8032400 | 3113 | 72.-.C;132.G.C | 0.363 | 0.277 |
| 2591751 | 3114 | 0.T.-;2.A.C;33.C.A | 0.363 | 0.290 |
| 851955 | 3115 | 76.G.-;82.A.G | 0.362 | 0.293 |
| 829720 | 3116 | -21.C.A;78.A.- | 0.362 | 0.340 |
| 8633205 | 3117 | 66.CT-G;133.A.C | 0.361 | 0.178 |
| 8367621 | 3118 | 86.-.G;131.A.C | 0.361 | 0.150 |
| 8652746 | 3119 | 65.GC.-T | 0.360 | 0.341 |
| 8641968 | 3120 | 66.CT.-- | 0.360 | 0.335 |
| 8489994 | 3121 | 76.-.G;125.T.G | 0.359 | 0.243 |
| 2271196 | 3122 | 0.T.-;134.G.T | 0.357 | 0.333 |
| 2684525 | 3123 | 0.T.-;2.A.C;132.G.A | 0.357 | 0.211 |
| 6557839 | 3124 | 18.C.A;74.-.T | 0.356 | 0.194 |
| 15057882 | 3125 | -29.A.G;0.T.-;2.A.C;74.T.- | 0.356 | 0.348 |
| 14812029 | 3126 | -29.A.C;78.A.G | 0.355 | 0.332 |
| 8565161 | 3127 | 75.CG.-T;127.T.G | 0.354 | 0.290 |
| 1042365 | 3128 | -17.C.A;77.GA.-- | 0.352 | 0.264 |
| 1114842 | 3129 | -16.C.A;75.-.C | 0.351 | 0.323 |
| 3011677 | 3130 | 1.TA.--;128.T.G | 0.349 | 0.272 |
| 8367531 | 3131 | 86.-.G;129.C.A | 0.349 | 0.129 |
| 8545111 | 3132 | 75.-.G;82.A.G | 0.349 | 0.279 |
| 13670603 | 3133 | -12.G.T;0.T.-;2.A.C | 0.347 | 0.221 |
| 8152309 | 3134 | 76.G-;80.A.G | 0.345 | 0.240 |
| 14635704 | 3135 | -29.C;0.T.-;78.A.- | 0.344 | 0.269 |
| 8101708 | 3136 | 75.CGG.-AT | 0.344 | 0.263 |
| 15738145 | 3137 | -32.G.T;76.-.G | 0.343 | 0.283 |
| 14351983 | 3138 | -25.A.C;73.A.- | 0.342 | 0.318 |
| 8066472 | 3139 | 74.T.-;127.T.G | 0.341 | 0.219 |
| 8134358 | 3140 | 75.-G.CT | 0.341 | 0.260 |
| 8603055 | 3141 | 73.A.-;129.C.A | 0.340 | 0.285 |
| 1251152 | 3142 | -15.T.G;82.AA.-T | 0.337 | 0.222 |
| 1005071 | 3143 | -17.C.A;1.TA.-- | 0.335 | 0.306 |
| 8137168 | 3144 | 76.G.-;104.C.A | 0.335 | 0.191 |
| 15158102 | 3145 | -29.A.G;72.-.C | 0.335 | 0.245 |
| 8129152 | 3146 | 75.-.C;121.C.T | 0.334 | 0.186 |
| 8208002 | 3147 | 88.G.-;130.T.G | 0.334 | 0.136 |
| 3581291 | 3148 | 2.-.A;72.-.C | 0.331 | 0.300 |
| 1251375 | 3149 | -15.T.G;80.A.- | 0.331 | 0.238 |
| 8128320 | 3150 | 75.-.C;127.T.C | 0.329 | 0.315 |
| 8356949 | 3151 | 87.-.G;118.T.G | 0.329 | 0.277 |
| 8552259 | 3152 | 75.C.-;86.C.- | 0.329 | 0.275 |
| 830221 | 3153 | -21.C.A;74.-.T | 0.378 | 0.279 |
| 2820364 | 3154 | 0.T.-;2.A.C;18.C.T | 0.328 | 0.303 |
| 15456319 | 3155 | -30.C.G;76.-.T | 0.328 | 0.240 |
| 8470089 | 3156 | 78.-.C;126.C.A | 0.328 | 0.285 |
| 8161135 | 3157 | 79.G.-;133.A.C | 0.327 | 0.249 |

TABLE 4-continued

Median Enrichment of DME Scaffold Variants

| index | SEQ ID NO | muts_lindexed | MI | 95% CI |
|---|---|---|---|---|
| 8481813 | 3158 | 78.A.-;119.C.T | 0.327 | 0.263 |
| 2684845 | 3159 | 0.T.-;2.A.C;126.C.T | 0.326 | 0.269 |
| 8128793 | 3160 | 75.-.C;126.C.T | 0.326 | 0.245 |
| 15405296 | 3161 | -30.C.G;0.T.- | 0.325 | 0.303 |
| 8595845 | 3162 | 70.-.T;129.C.A | 0.374 | 0.292 |
| 8105737 | 3163 | 76.GG.-A;131.A.C;133.A.C | 0.323 | 0.215 |
| 8470189 | 3164 | 78.-.C;129.C.A | 0.323 | 0.298 |
| 14245594 | 3165 | -24.G.T;80.A.- | 0.323 | 0.259 |
| 1251224 | 3166 | -15.T.G;81.GA.-T | 0.323 | 0.237 |
| 7939926 | 3167 | 65.G.-;76.G.- | 0.322 | 0.229 |
| 8648998 | 3168 | 65.G.T;76.G.- | 0.322 | 0.165 |
| 14098317 | 3169 | -20.A.C;2.A.- | 0.321 | 0.261 |
| 8032447 | 3170 | 72.-.C;131.A.C | 0.320 | 0.251 |
| 8061102 | 3171 | 74.T.-;76.G.C | 0.370 | 0.180 |
| 8481588 | 3172 | 78.A.-;120.C.T | 0.320 | 0.267 |
| 8565286 | 3173 | 75.CG.-T;130.T.C | 0.320 | 0.300 |
| 14245896 | 3114 | -24.G.T;76.-.G | 0.319 | 0.198 |
| 8066445 | 3175 | 74.T.-;127.T.C | 0.319 | 0.230 |
| 8150200 | 3176 | 77.-.A;129.C.A | 0.318 | 0.223 |
| 8479230 | 3177 | 78.A.-;118.T.G | 0.316 | 0.213 |
| 8482576 | 3178 | 78.A.-;113.A.C | 0.314 | 0.236 |
| 2271423 | 3179 | 0.T.-;123.A.C | 0.313 | 0.263 |
| 13907909 | 3180 | -14.A.G;0.T.-;2.A.C | 0.313 | 0.242 |
| 8066743 | 3181 | 74.T.-;131.A.C;133.A.C | 0.312 | 0.214 |
| 8352697 | 3182 | 86.C.-128.T.G | 0.311 | 0.186 |
| 301021 | 3183 | -28.G.C;0.T.-;2.A.C | 0.308 | 0.178 |
| 8480313 | 3184 | 78.A.-;125.T.G | 0.307 | 0.265 |
| 8136771 | 3185 | 76.G.-;87.C.A | 0.306 | 0.204 |
| 8019966 | 3186 | 72.-.A;82.A.- | 0.305 | 0.276 |
| 8632613 | 3187 | 66.CT.-G;121.C.A | 0.305 | 0.181 |
| 8583599 | 3188 | 73.AT.-G;88.G.- | 0.305 | 0.282 |
| 8475891 | 3189 | 78.A.-;88.G.- | 0.304 | 0.243 |
| 8567785 | 3190 | 75.C.T;77.-.A | 0.304 | 0.161 |
| 8448066 | 3191 | 80.A.-;129.C.A | 0.303 | 0.215 |
| 8136691 | 3192 | 76.G.-;86.C.A | 0.302 | 0.196 |
| 15059855 | 3193 | -29.A.G;0.T.-;2.A.C;66.CT.-G | 0.301 | 0.258 |
| 13171297 | 3194 | -1.G.T;76.-.G | 0.300 | 0.250 |
| 8470230 | 3195 | 78.-.C;130.T.G | 0.300 | 0.279 |
| 8142877 | 3196 | 76.G.-;134.G.C | 0.299 | 0.198 |
| 555214 | 3197 | -26.T.C;76.G.- | 0.298 | 0.182 |
| 446048 | 3198 | -27.C.A;80.A.- | 0.298 | 0.210 |
| 8436528 | 3199 | 81.GA.-T;121.C.A | 0.297 | 0.283 |
| 8353141 | 3200 | 86.C.-;122.A.C | 0.296 | 0.246 |
| 8565426 | 3201 | 75.CG-T;131.A.G | 0.296 | 0.236 |
| 8132576 | 3202 | 75.-.C;89.-.C | 0.296 | 0.216 |
| 8092121 | 3203 | 75.-.A;116.T.G | 0.295 | 0.277 |
| 8633166 | 3204 | 66.CT.G;132.G.C | 0.295 | 0.138 |
| 8142165 | 3205 | 76.G.-;124.T.C | 0.295 | 0.253 |
| 2686290 | 3206 | 0.T.-;2.A.C;114.G.T | 0.295 | 0.236 |
| 8161038 | 3207 | 79.G.-;129.C.A | 0.293 | 0.266 |
| 13853578 | 3208 | -14.A.C;76.-.T | 0.293 | 0.239 |
| 807836 | 3209 | -21.C.A;1.TA.-- | 0.292 | 0.265 |
| 8469754 | 3210 | 78.-.C;119.C.A | 0.291 | 0.158 |
| 8137474 | 3211 | 76.G.-;101.C.A | 0.291 | 0.226 |
| 8160587 | 3212 | 79.G.-;120.C.A | 0.290 | 0.161 |
| 8142955 | 3213 | 76.G.-;131.AGA.CCC | 0.29C | 0.156 |
| 8762708 | 3214 | 56.G.T;75.-.G | 0.289 | 0.245 |
| 14635887 | 3215 | 0.T.-;-29.A.C;75.-.G | 0.288 | 0.221 |
| 15455571 | 3216 | -30.C.G;78.-.C | 0.287 | 0.151 |
| 8066265 | 3217 | 74.T.-;124.T.G | 0.285 | 0.185 |
| 8436842 | 3218 | 81.GA.-T;130.T.G | 0.283 | 0.228 |
| 13846354 | 3219 | -14.A.C;79.G.- | 0.282 | 0.195 |
| 8490993 | 3220 | 76.-.G;121.C.T | 0.281 | 0.238 |
| 14646258 | 3221 | -29.A.C;0.T.-;2.A.C.87.-.T | 0.281 | 0.281 |
| 8431378 | 3222 | 82.AA.-T;120.C.A | 0.279 | 0.217 |
| 8431703 | 3223 | 82.AA.-T;126.C.A | 0.279 | 0.249 |
| 447910 | 3224 | -27.C.A;73.AT.-G | 0.279 | 0.215 |
| 8066683 | 3225 | 74.T.-;130.--T.TAG;133.A.G | 0.779 | 0.236 |
| 2760011 | 3226 | 0.T.-;2.A.C;58.G.T | 0.278 | 0.250 |
| 3012063 | 3227 | 1.TA.--;123.A.C | 0.278 | 0.271 |
| 13855018 | 3228 | -14.A.C;73.A.- | 0.277 | 0.240 |
| 8447252 | 3229 | 80.A.-;119.C.A | 0.277 | 0.261 |
| 8489127 | 3230 | 76.-.G;118.T.G | 0.776 | 0.269 |
| 8526408 | 3231 | 76.-.T;126.C.A | 0.775 | 0.187 |
| 8446211 | 3232 | 80.A.-;115.T.G | 0.273 | 0.177 |
| 8431937 | 3233 | 82.AA.-T;133.A.C | 0.272 | 0.216 |
| 6558231 | 3234 | 18.C.A;73.A.- | 0.271 | 0.209 |
| 8159873 | 3235 | 79.G.-;115.T.G | 0.271 | 0.220 |
| 8602463 | 3236 | 73.A.-;119.C.A | 0.268 | 0.230 |
| 2684642 | 3237 | 0.T.-;2.A.C;131.AGA.CCC | 0.268 | 0.194 |
| 8143095 | 3238 | 76.G.-.126.C.G | 0.266 | 0.206 |
| 1042210 | 3239 | -17.C.A;79.G.- | 0.264 | 0.153 |
| 15452123 | 3240 | -30.C.G;88.G.- | 0.263 | 0.246 |
| 13852053 | 3241 | -14.A.C;80.A.- | 0.262 | 0.238 |
| 8435985 | 3242 | 81.GA.-T;115.T.G | 0.262 | 0.210 |
| 223220 | 3243 | -30.C.A;76.G.- | 0.261 | 0.213 |
| 12148242 | 3244 | 2.A.-;124.T.C. | 0.260 | 0.232 |
| 8602984 | 3245 | 73.A.-;127.T.G | 0.259 | 0.174 |
| 318643 | 3246 | -28.G.C;75.-.C | 0.259 | 0.254 |
| 15451555 | 3247 | -30.C.G;79.G.- | 0.259 | 0.228 |
| 8436802 | 3248 | 81.GA.-T;129.C.A. | 0.258 | 0.221 |
| 8512529 | 3249 | 76.G.-;78.A.T;131.A.C | 0.257 | 0.192 |
| 8519060 | 3250 | 76.GG.-T;124.T.G | 0.255 | 0.178 |
| 1045581 | 3251 | -17.C.A;78.-.C | 0.254 | 0.161 |
| 13844608 | 3252 | -14.A.C;74.T.- | 0.252 | 0.231 |
| 13171509 | 3253 | -1.G.T;76.GG.-T | 0.251 | 0.179 |
| 8336250 | 3254 | 89.-.C;121.C.A | 0.248 | 0.177 |
| 15455277 | 3255 | -30.C.G;80.A.- | 0.246 | 0.216 |
| 8353067 | 3256 | 86.C.-;123.A.C | 0.246 | 0.146 |
| 8161013 | 3257 | 79.G.-;128.T.G | 0.245 | 0.184 |
| 8105760 | 3258 | 76.GG.-A;129.C.G | 0.244 | 0.201 |
| 8558713 | 3259 | 74.-.T;123.A.C | 0.243 | 0.218 |
| 2681904 | 3260 | 0.T.-;2.A.C;116.T.C | 0.243 | 0.228 |
| 8558310 | 3261 | 74.-.T;127.T.C | 0.239 | 0.165 |
| 2684449 | 3262 | 0.T.-;2.A.C;130.T.C;132.G.C | 0.235 | 0.191 |
| 15052207 | 3263 | -29.A.G;0.T.-;75.-.G | 0.233 | 0.279 |
| 8524468 | 3264 | 76.G.T;78.A.- | 0.232 | 0.184 |
| 7490514 | 3265 | 36.C.A;76.GG.-A | 0.231 | 0.201 |
| 8633217 | 3266 | 66.CT.-G132.G.T | 0.275 | 0.188 |
| 8069615 | 3267 | 74.T.-;89.-.C | 0.224 | 0.182 |
| 15451403 | 3268 | -30.C.G;77.-.A | 0.224 | 0.142 |
| 8520167 | 3269 | 76.GG.-T;119.C.T | 0.222 | 0.182 |
| 10994911 | 3270 | 8.G.T;76.G.- | 0.222 | 0.186 |
| 2272784 | 3271 | 0.T.-;113.A.G | 0.218 | 0.188 |
| 8100983 | 3272 | 75.C.A;87.-.C | 0.209 | 0.207 |
| 13851721 | 3273 | -14.A.C;82.AA.-T | 0.209 | 0.191 |
| 8084086 | 3274 | 74.-.G;130.T.C | 0.207 | 0.200 |
| 8564034 | 3275 | 75.CG.-T;116.T.G | 0.206 | 0.195 |
| 1117838 | 3276 | -16.C.A;75.CG.-T | 0.205 | 0.200 |
| 14023671 | 3277 | -19.G.T;76.GG.-T | 0.205 | 0.189 |
| 8519544 | 3278 | 76.GG.-T;131.A.C;133.A.C | 0.201 | 0.159 |
| 8633185 | 3279 | 66.CT.-G | 0.200 | 0.137 |
| 14817545 | 3280 | -29.A.C;66.CT.-G | 0.199 | 0.147 |
| 1482006 | 3281 | -9.T.C;76.G.- | 0.199 | 0.183 |
| 14524849 | 3282 | -28.G.T;75.-.C | 0.198 | 0.181 |
| 8470132 | 3283 | 78.-C;127.T.G | 0.197 | 0.192 |
| 7738954 | 3284 | 51.C.A;76.G.- | 0.189 | 0.175 |
| 1247296 | 3285 | -15.T.G;79.G.- | 0.189 | 0.163 |
| 8519864 | 3286 | 76.GG.-T;122.A.G | 0.188 | 0.125 |
| 1117512 | 3287 | -16.C.A;76.GG.-T | 0.185 | 0.166 |
| 15171788 | 3288 | -29.A.G;66.CT.-G | 0.184 | 0.119 |
| 8601732 | 3289 | 73.A.-115.T.G | 0.183 | 0.174 |
| 6556220 | 3290 | 18.C.A;86.C.- | 0.182 | 0.124 |
| 8633071 | 3291 | 66.CT.-G;129.C.A | 0.175 | 0.164 |
| 8499488 | 3292 | 78.A.-;80.A.G | 0.171 | 0.166 |
| 8519321 | 3293 | 76.GG.-T;128.T.C | 0.169 | 0.133 |
| 14348190 | 3294 | -25.A.C;86.C.- | 0.165 | 0.107 |
| 321013 | 3295 | -28.G.C;74.-.T | 0.164 | 0.163 |

Approximately 140 modified gRNAs were generated, some by DME and some by targeted engineering, and assayed for their ability to disrupt expression of a target GFP reporter construct by creation of indels. Sequences for these gRNA variants are shown in Table 2. These modified gRNAs exclude modifications to the spacer region, and instead comprise different modified scaffolds (the portion of the sgRNA that interacts with the CRISPR protein). gRNA scaffolds generated by DME include one or more deletions, substitutions, and insertions, which can consist of a single or several base pairs. The remaining gRNA variants were rationally engineered based on knowledge of thermostable RNA structures, and are either terminal fusions of ribozymes or insertions of highly stable stem loop sequences. Additional gRNAs were generated by combining gRNA variants. The results for select gRNA variants are shown in Table 5 below.

TABLE 5

Ability of select gRNA variants to disrupt GFP expression

| SEQ ID NO: | NAME (Description) | Normalized Editing Activity (ave, 2) spacers n = 6) | Std. dev. |
|---|---|---|---|
| 5 | X2 reference | — | — |
| 2101 | phage replication stable | 1.42 | 0.22 |
| 2102 | Kissing loop_b1 | 1.17 | 0.11 |
| 2103 | Kissing loop_a | 1.18 | 0.03 |
| 2104 | 32, uvsX hairpin | 1.89 | 0.11 |
| 2105 | PP7 | 1.08 | 0.04 |
| 2106 | 64, trip mut, extended stem truncation | 1.69 | 0.18 |
| 2107 | hyperstable tetraloop | 1.36 | 0.11 |
| 2108 | C18G | 1.22 | 0.42 |
| 2109 | T17G | 1.27 | 0.04 |
| 2110 | CUUCGG loop | 1.24 | 0.22 |
| 2111 | MS2 | 1.12 | 0.25 |
| 2112 | −1, A2G, −78, G77T | 1.00 | 0.18 |
| 2113 | QB | 1.44 | 0.25 |
| 2114 | 45,44 hairpin | 0.24 | 0.41 |
| 2115 | U1A | 1.02 | 0.05 |
| 2116 | A14C, T17G | 0.86 | 0.01 |
| 2117 | CUUCGG loop modified | 0.75 | 0.04 |
| 2118 | Kissing loop_b2 | 0.99 | 0.06 |
| 2119 | −76:78, −83:87 | 0.97 | 0.01 |
| 7120 | −4 | 0.93 | 0.03 |
| 2121 | extended stem truncation | 0.73 | 0.02 |
| 2124 | −98:100 | 0.66 | 0.05 |
| 2125 | −1:5 | 0.45 | 0.05 |
| 2176 | −2163 | 0.57 | 0.07 |
| 2127 | =+628, A82T, −84, | 0.56 | 0.04 |
| 2128 | =+51T | 0.52 | 0.03 |
| 2129 | −1:4, +G5A, +G86, | 0.09 | 0.21 |
| 2130 | 2174 | 0.34 | 0.09 |
| 2131 | +g72 | 0.34 | 0.24 |
| 2132 | shorten front, CUUCGG loop modified. extend extended | 0.65 | 0.02 |
| 2133 | A14C | 0.37 | 0.03 |
| 2134 | −1:3, +G3 | 0.45 | 0.16 |
| 2135 | =+C45, +T46 | 0.42 | 0.04 |
| 2136 | CUUCGG loop modified, fun start | 0.38 | 0.03 |
| 2137 | −74:75 | 0.18 | 0.04 |
| 2138 | ˜T45 | 0.21 | 0.05 |
| 2139 | −69, −94 | 0.24 | 0.09 |
| 2140 | −94 | 0.01 | 0.01 |
| 2141 | modified CUUCGG, minus T in 1st triplex | 0.04 | 0.03 |
| 2142 | −1:4, +C4, A14C, T17G, +G72, −76:78, −83:87 | 0.16 | 0.03 |
| 2143 | TIC, −73 | 0.06 | 0.06 |
| 2144 | Scaffold uuCG, stem uuCG, Stem swap, t shorten | 0.01 | 0.09 |
| 2145 | Scaffold uuCG, stem uuCG, Stem swap | 0.04 | 0.03 |
| 2146 | 0.0090408 | 0.06 | 0.04 |
| 2147 | no stem Scaffold uuCG | −0.11 | 0.02 |
| 2148 | no stem Scaffold uuCG, fun start | −0.06 | 0.02 |
| 2149 | Scaffold uuCG, stem uuCG, fun start | −0.02 | 0.02 |
| 2150 | Pseudoknots | −0.01 | 0.01 |
| 2151 | Scaffold uuCG, stem uuCG | −0.05 | 0.01 |
| 2152 | Scaffold uuCG, stem uuCG, no start | −0.04 | 0.07 |
| 2153 | Scaffold uuCG | −0.12 | 0.07 |
| 2154 | +GCTC36 | −0.20 | 0.05 |
| 2155 | G quadriplex telomere basket + ends | −0.21 | 0.02 |
| 2156 | G quadriplex M3q | −0.25 | 0.04 |
| 2157 | G quadriplex telomere basket no ends | −0.17 | 0.04 |
| 2159 | Sarcin-ricin loop | 0.40 | 0.03 |
| 2160 | uvsX, C18G | 1.94 | 0.06 |
| 2161 | truncated stem loop, C18G, trip mut (T10C) | 1.97 | 0.16 |
| 2162 | short phage rep, C18G | 1.91 | 0.17 |
| 2163 | phage rep loop, C18G | 1.72 | 0.13 |
| 2164 | +G18, stacked onto 64 | 1.44 | 0.08 |
| 2165 | truncated stem loop, C18G, −1 A2G | 1.63 | 0.40 |
| 2166 | phage rep loop, C18G, trip mut (T10C) | 1.76 | 0.12 |
| 2167 | short phage rep, Cl8G, trip mut (TUC) | 1.20 | 0.09 |
| 2168 | uvsX, trip mut (T10C) | 1.54 | 0.12 |

TABLE 5-continued

Ability of select gRNA variants to disrupt GFP expression

| SEQ ID NO: | NAME (Description) | Normalized Editing Activity (ave, 2) spacers n = 6 | Std. dev. |
|---|---|---|---|
| 2169 | truncated stem loop | 1.50 | 0.10 |
| 2170 | +A17, stacked onto 64 | 1.54 | 0.13 |
| 2171 | 3' HDV gnomic ribozyme | 1.13 | 0.13 |
| 2172 | phage rep loop, trip mut (T10C) | 1.39 | 0.10 |
| 2173 | −79:80 | 1.33 | 0.05 |
| 2174 | short phage rep, trip mut (T10C) | 1.19 | 0.10 |
| 2175 | extra truncated stem loop | 1.08 | 0.05 |
| 2176 | T17G, C18G | 0.94 | 0.09 |
| 2177 | short phage rep | 1.11 | 0.05 |
| 2178 | uvsX, C18G, −1b A2G | 0.62 | 0.08 |
| 2179 | uvsX, C18G, trip mut (T10C), −1 A2G, HDV −99 G65T | 1.06 | 0.08 |
| 2180 | 3' HDV antigenomic ribozyme | 1.20 | 0.07 |
| 2181 | uvsX, C18G, trip mut (T10C), −1 A2G, HDV AA(98:99)C | 0.95 | 0.03 |
| 2182 | 3' HDV ribozyme (Lior Nissim, Timothy Lu | 1.08 | 0.01 |
| 2183 | TAC(1:3)GA, stacked onto 64 | 0.92 | 0.04 |
| 2184 | uvsX, −1 A2G | 1.46 | 0.13 |
| 2185 | truncated stem loop, C18G, trip mut (T10C), −1 A2G, HDV −99 G65T | 0.80 | 0.02 |
| 2186 | short phage rep, C18G, trip mut (T10C), −1 A2G, HDV −99 G651 | 0.80 | 0.05 |
| 2187 | 3' sTRSV WT viral Hammerhead ribozyme | 0.98 | 0.03 |
| 2188 | short phage rep, C18G, −1 A2G | 1.78 | 0.18 |
| 2189 | short phage rep, C18G, trip mut (T10C), −1 A2G, 3' genomic HDV | 0.81 | 0.08 |
| 2190 | phage rep loop, C18G, trip mut (T10C), −1 A2G, HDV −99 G65T | 0.86 | 0.07 |
| 2191 | 3' HDV ribozyme (Owen Ryan, Jamie Cate) | 0.78 | 0.04 |
| 2192 | phage rep loop, C18G, −1 A2G | 0.70 | 0.08 |
| 2193 | ^C55 | 0.78 | 0.03 |
| 2194 | −78, G77T | 0.73 | 0.07 |
| 2195 | ^G1 | 0.73 | 0.10 |
| 2196 | short phage rep, −1 A2G | 0.66 | 0.11 |
| 2197 | truncated stem loop, C18G, trip mut (T10C), −1 A2G | 0.68 | 0.09 |
| 2198 | −1, A2G | 0.54 | 0.07 |
| 2199 | truncated stem loop, trip mut (T10C), −1 A2G | 0.40 | 0.03 |
| 2200 | uvsX, C18G, trip mut (T10C), −1 A2G | 0.35 | 0.11 |
| 2201 | phage rep loop, −1 A2G | 0.96 | 0.05 |
| 2202 | phage rep loop, trip mut (T10C), −1 A2G | 0.49 | 0.06 |
| 2203 | phase rep loop, C18G, trip mut (T10C), −1 A2G | 0.73 | 0.13 |
| 2204 | truncated stem loop, C18G | 0.59 | 0.02 |
| 2205 | uvsX, trip mut (T10C), −1 A2G | 0.56 | 0.08 |
| 2206 | truncated stem loop, −1 A2G | 0.89 | 0.07 |
| 2207 | short phage rep, trip mut (T10C), −1 A2G | 0.37 | 0.12 |
| 2208 | 5'HDV ribozme (Owen Ryan, Jamie Cate) | 0.39 | 0.03 |
| 2209 | 5'HDV genomic ribozyme | 0.35 | 0.06 |
| 2210 | truncated stem loop, C18G, trip mut (T10C), −1 A2G, HDV AA(98:99)C | 0.24 | 0.04 |
| 2211 | 5'env25 pistol ribozyme(with an added CUUCGG loop) | 0.33 | 0.07 |
| 2212 | 5'HDV antigenomic ribozyme | 0.17 | 0.01 |
| 2213 | 3' Hammerhead ribozyme (Lior Nissim, Timothy Lu) guide scaffold scar | 0.09 | 0.02 |
| 2214 | +A27, stacked onto 64 | 0.03 | 0.03 |
| 2215 | 5'Hammerhead ribozyme (Lior Nissim, Timothy Lu) smaller scar | 0.18 | 0.03 |
| 2216 | phage rep loop, C18G, trip mut (T10C), −1 A2G, HDV AA(98:99)C | 0.13 | 0.04 |
| 2217 | −27, stacked onto 64 | 0.00 | 0.03 |
| 2218 | 3' Hatchet | 0.09 | 0.01 |
| 2219 | 3' Hammerhead ribozyme (Lior Nissim, Timothy Lu) | 0.05 | 0.03 |
| 7220 | 5'Hatchet | 0.04 | 0.03 |
| 2221 | 5'HDV ribozyme (Lior Nissitn, Timothy Lu) | 0.08 | 0.01 |
| 7222 | 5'Hammerhead ribozyme (Lior Nissim, Timothy Lu) | 0.22 | 0.01 |
| 2223 | 3' HH15 Minimal Hammerhead ribozyme | 0.01 | 0.01 |
| 2224 | 5' RBMX recruiting motif | −0.08 | 0.03 |
| 7225 | 3' Hammerhead ribozyme (Lior Nissim, Timothy Lu) smaller scar | −0.04 | 0.02 |

TABLE 5-continued

Ability of select gRNA variants to disrupt GFP expression

| SEQ ID NO: | NAME (Description) | Normalized Editing Activity (ave, 2) spacers n = 6) | Std. dev. |
|---|---|---|---|
| 2226 | 3' env25 pistol ribozyme(with an added CUUCGG loop) | −0.01 | 0.01 |
| 2227 | 3' Env-9 Twister | −0.17 | 0.02 |
| 2228 | +ATTATCTCATTACT25 | −0.18 | 0.27 |
| 7229 | 5'Env-9 Twister | −0.02 | 0.01 |
| 2230 | 3' Twisted Sister 1 | −0.27 | 0.02 |
| 7231 | no stem | −0.15 | 0.03 |
| 2232 | 5'HH15 Minimal Hammerhead ribozyme | −0.18 | 0.04 |
| 2233 | 5'Hammerhead ribozyme (Lior Nissim, Timothy Lu) guide scaffold scar | −0.14 | 0.01 |
| 2234 | 5'Twisted Sister 1 | −0.14 | 0.04 |
| 7235 | 5'sTRSV WT viral Hammerhead ribozyme | −0.15 | 0.02 |
| 2236 | 148, =+G55, stacked onto 64 | 3.40 | 0.18 |
| 2239 | 175, trip mut, extended stem truncation, with [T] deletion at 5' end | 1.18 | 0.09 |

Although guide stability can be measured thermodynamically (for example, by analyzing melting temperatures) or kinetically (for example, using optical tweezers to measure folding strength), without wishing to be bound by any theory it is believed that a more stable sgRNA bolsters CRISPR editing efficiency. Thus, editing efficiency was used as the primary assay for improved guide function.

The activity of the gRNA scaffold variants was assayed using E6 and E7 spacers as described above, targeting GFP. The starting sgRNA scaffold in this case was a reference *Planctomyces* CasX tracr RNA fused to a *Planctomyces* crispr RNA (crRNA) using a "GAAA" stem loop (SEQ ID NO: 5). This sgRNA scaffold was used a base for DME and rationally engineered mutations. The activity of variant gRNAs shown in Table 6 was normalized to the activity of this starting, or base, sgRNA scaffold.

The sgRNA scaffold was cloned into a small (less than 3 kilobase pair) plasmid with a 3' type II restriction enzyme site for dropping in different spacers. The spacer region of the sgRNA is the part of the sgRNA interacts with the target DNA, and does not interact directly with the CasX protein. Thus, scaffold engineering should be spacer independent. One way to achieve this is by executing sgRNA DME and testing engineered sgRNA variants using several distinct spacers, such as the E6 and E7 spacers targeting GFP. This reduces the possibility of creating an sgRNA scaffold variant that works well with one spacer sequence targeting one genetic target, but not other spacer sequences directed to other targets. For the data shown in Table, 6, the E6 and E7 spacer sequences targeting GFP were used. Repression of GFP expression by sgRNA variants was normalized to GFP repression by the sgRNA starting scaffold of SEQ ID NO: 5 assayed with the same spacer sequence(s).

Figure 5C:
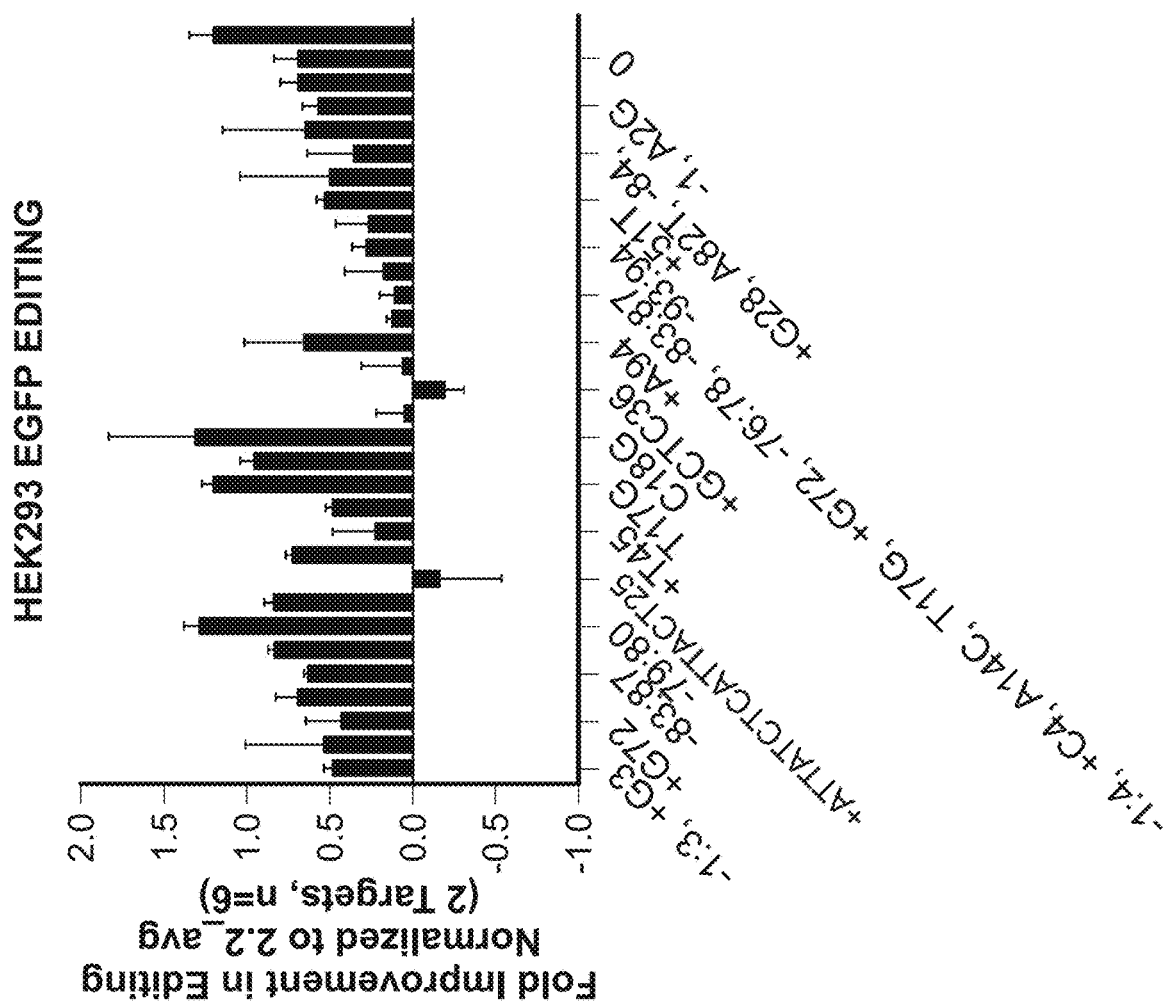
Figure 5D:
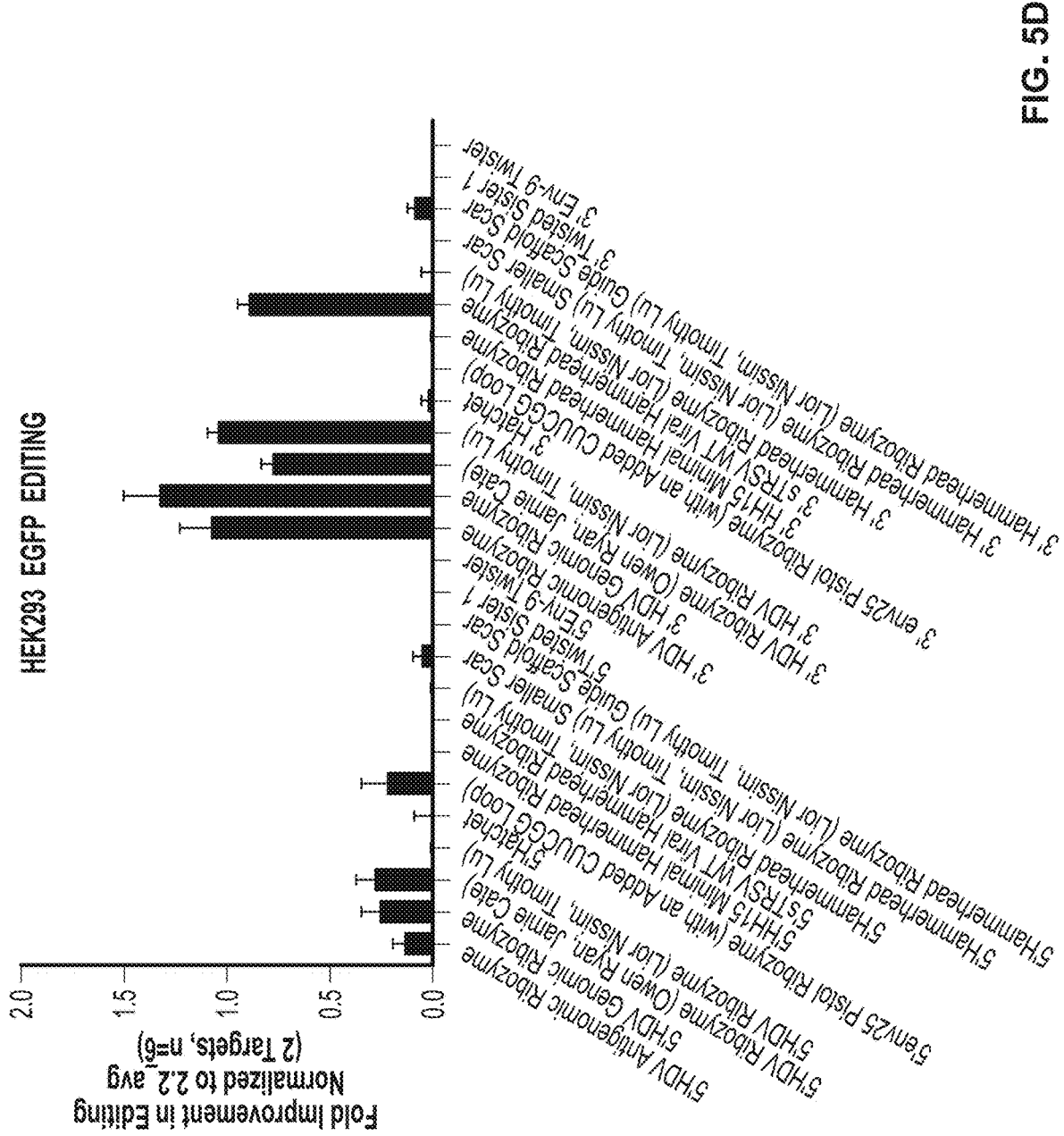
Figure 5E:
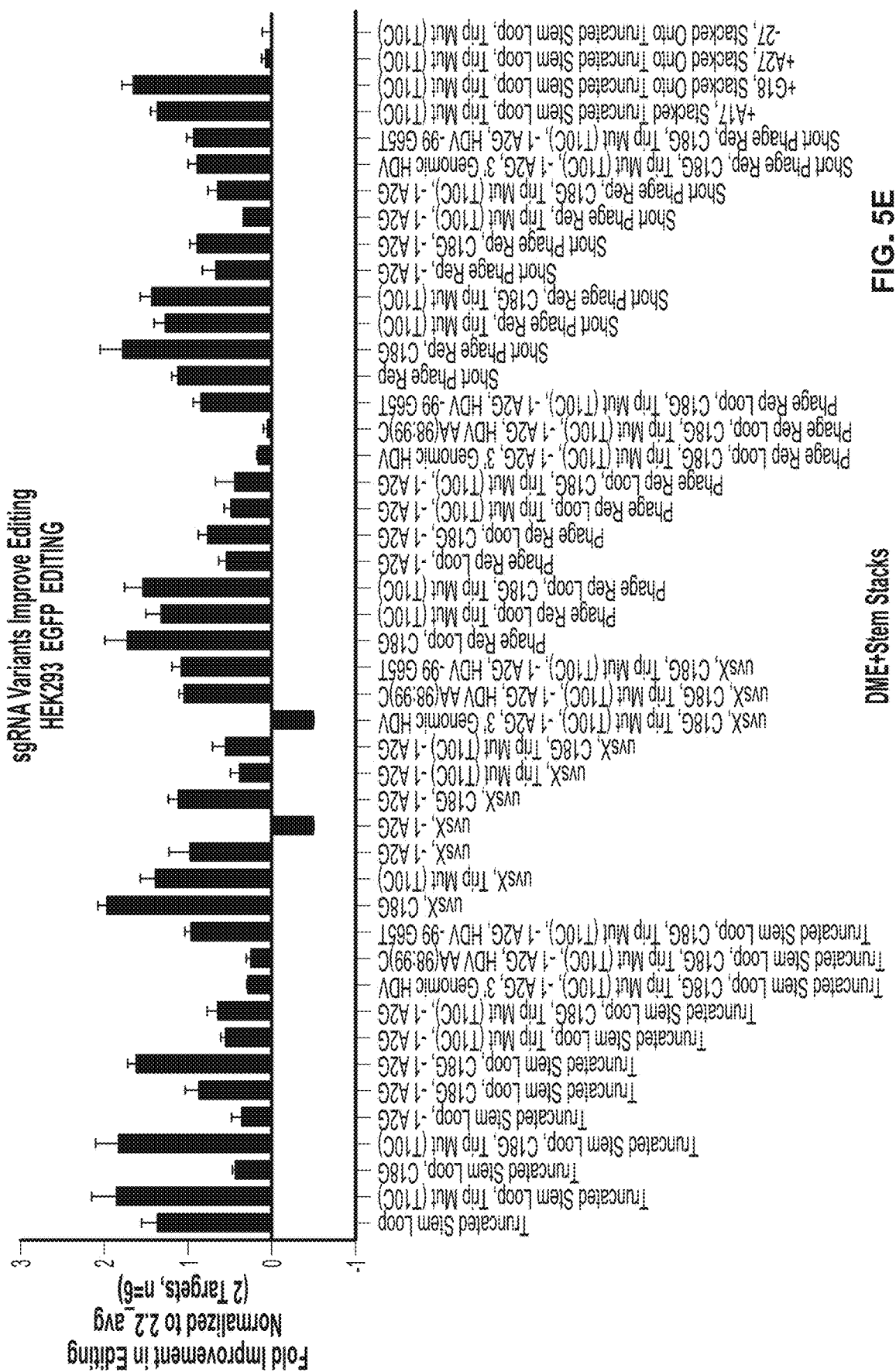
Figure 6:
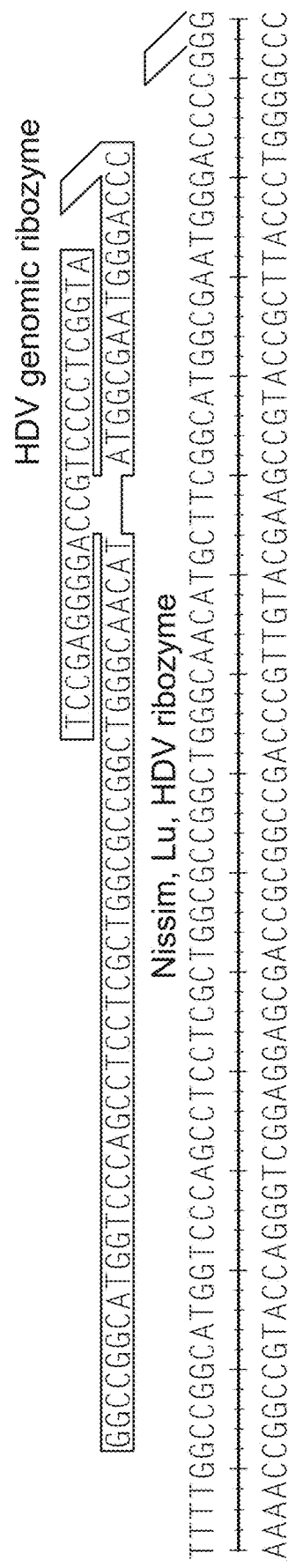
FIG. 6 shows a Hepatitis Delta Virus (HDV) genomic ribozyme used in exemplary gNA variants (SEQ ID NOs: 18-22).
Figure 7A:
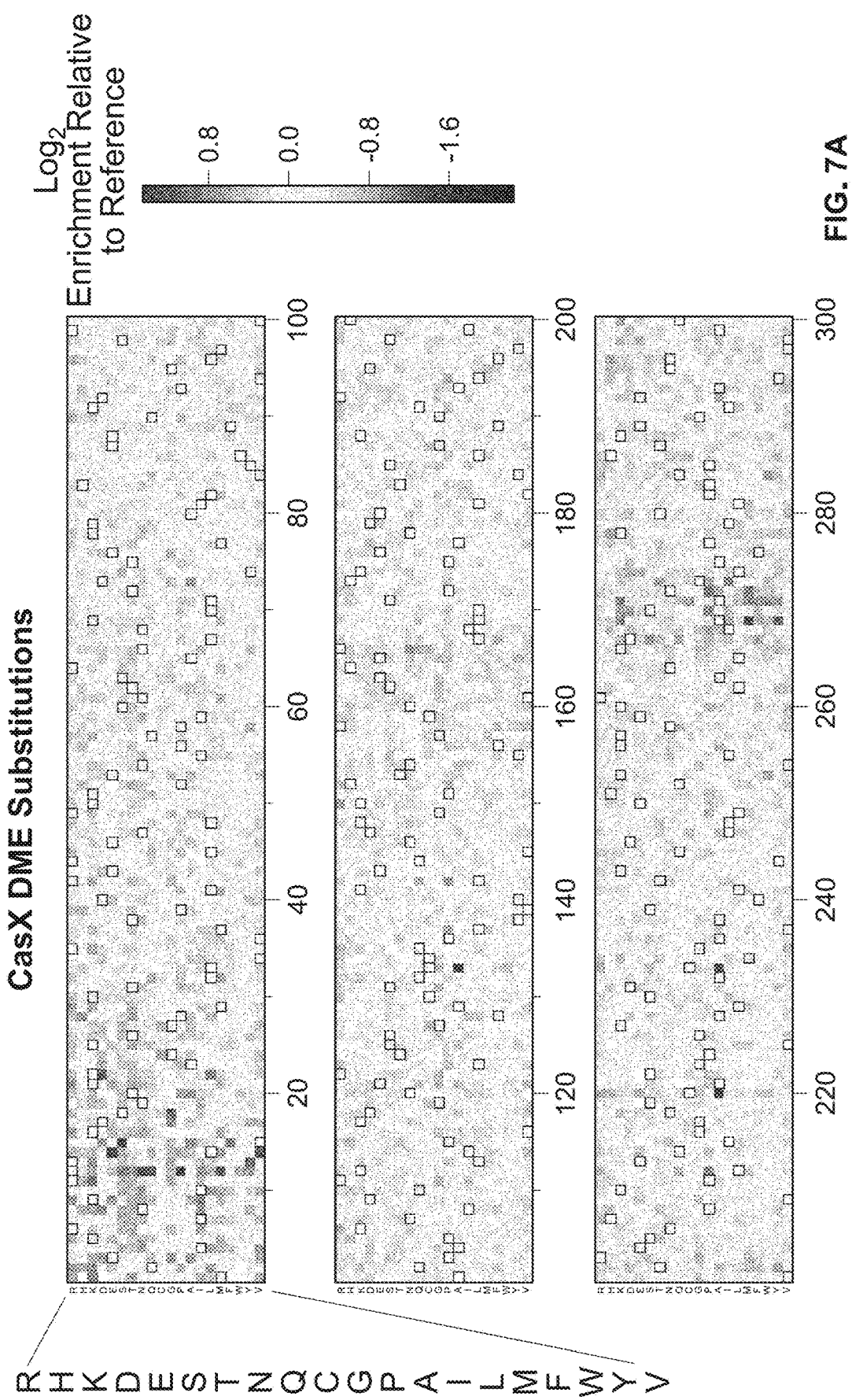
FIGS. 7A-7I are a series of heat maps showing the effect of single amino acid substitutions, single amino acid insertions, and deletions at each amino acid position in a reference CasX protein of SEQ ID NO: 2, as described in Example 4. Data were generated by a DME assay run at 37° C. The Y-axis shows each possible substitution or insertion (from top to bottom: R, H, K, D, E, S, T, N, Q, C, G, P, A, I, L, M, F, W, Y or V; boxes indicate the amino acid identity of the reference protein), the X-axis shows the amino acid position in the reference CasX protein. $Log_2$ fold enrichment of the CasX variant protein relative to the reference CasX protein of SEQ ID NO: 2 in a DME library following enrichment is indicated. As used herein, "enrichment" is a proxy for activity, where greater enrichment is a more active molecule. (*)s indicate active sites.
Figure 7B:
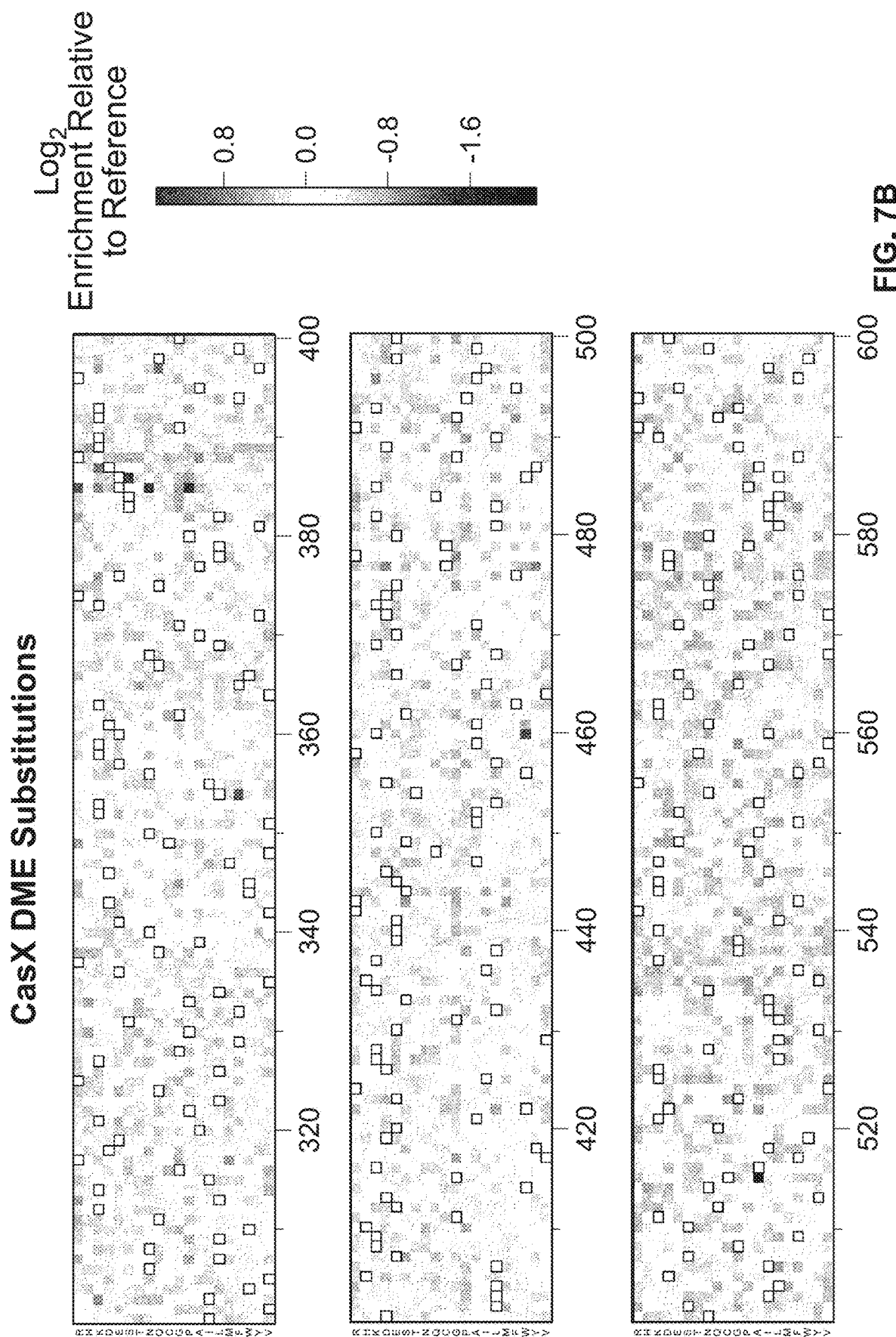
Figure 7C:
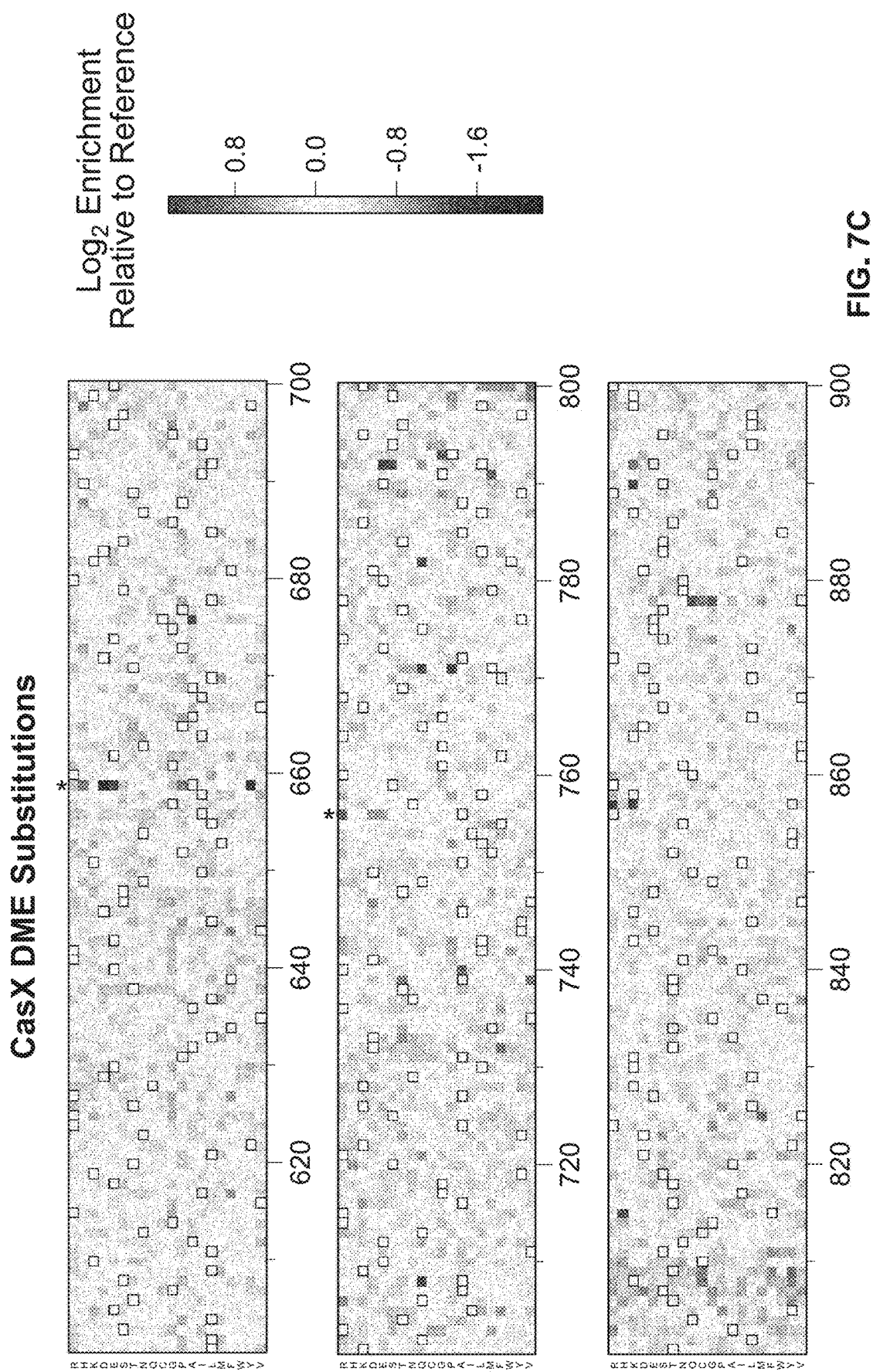
Figure 7D:
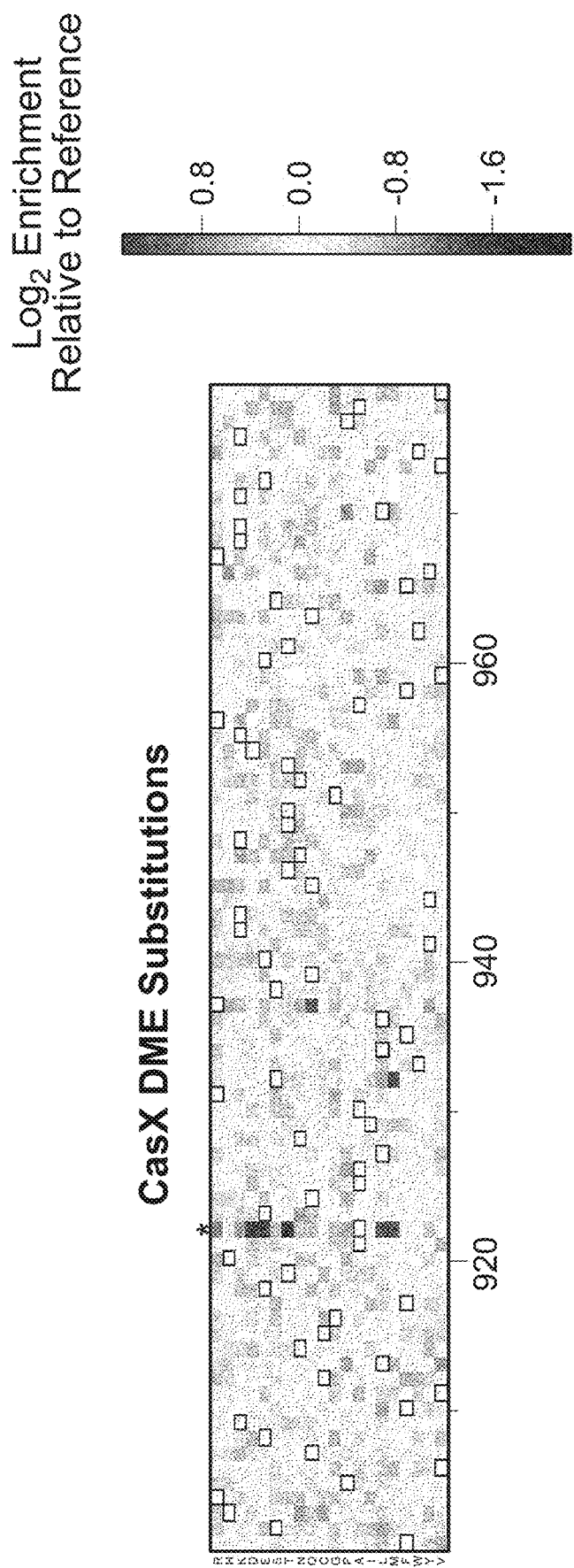
Figure 7E:
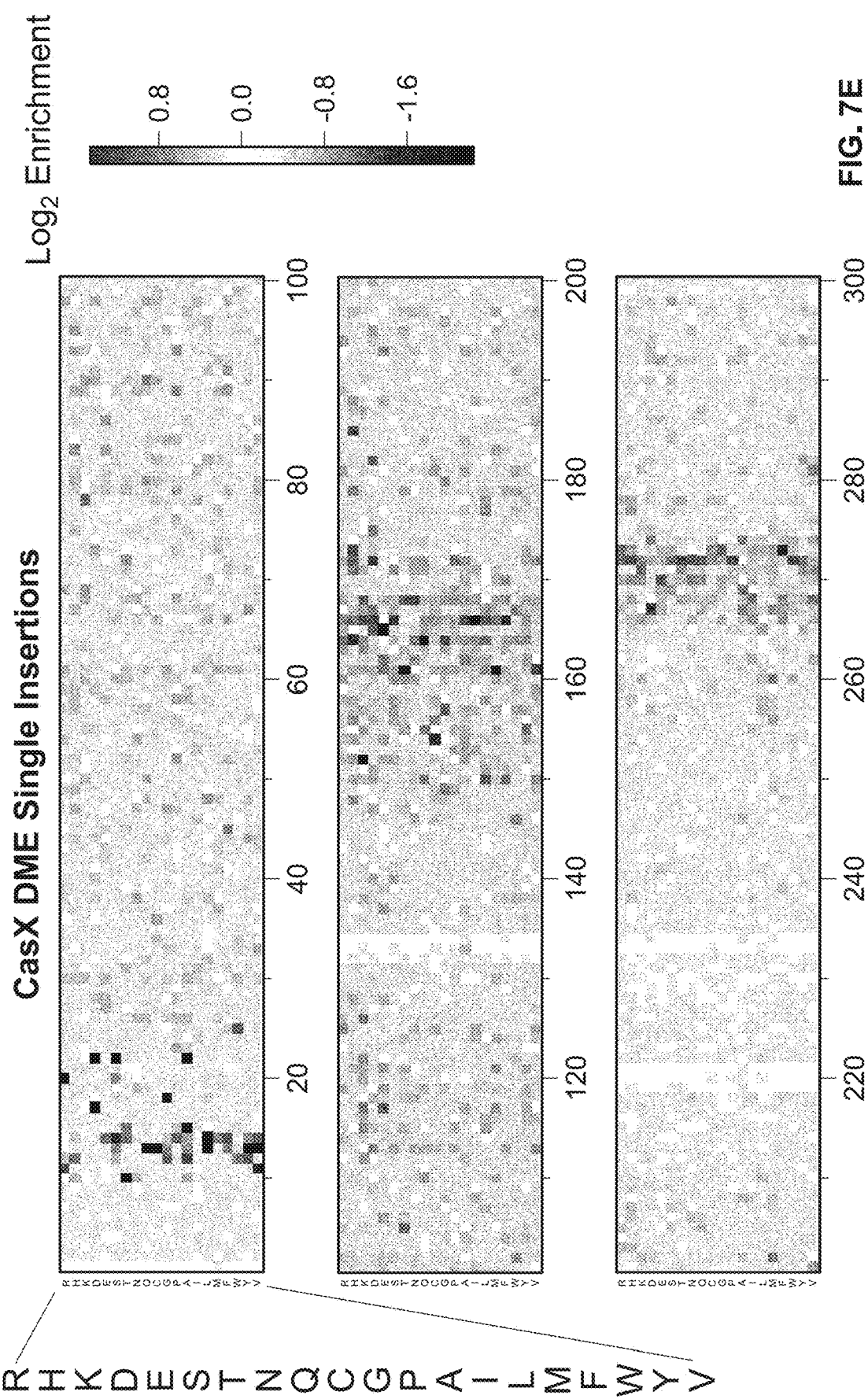
Figure 7F:
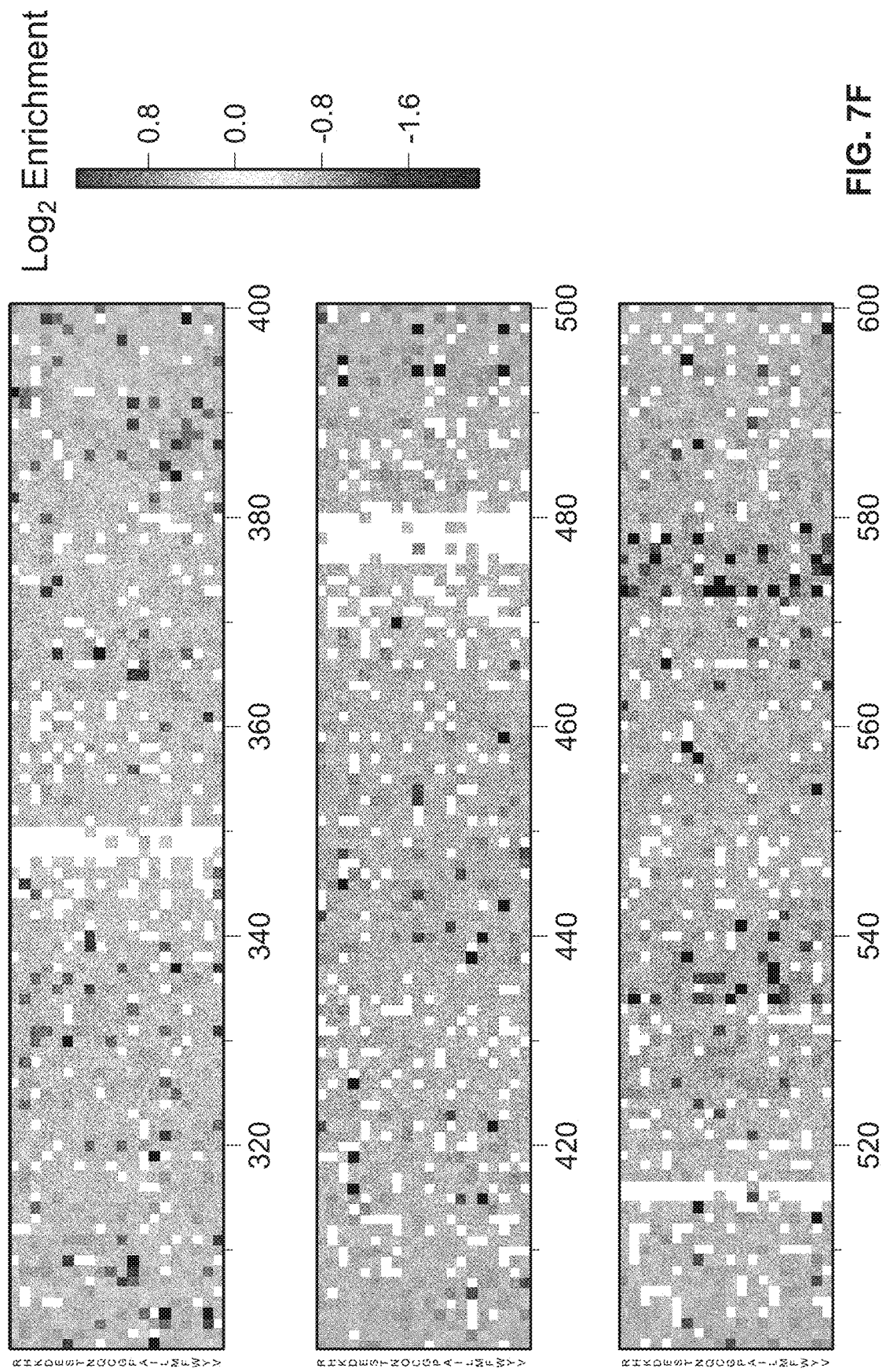
Figure 7G:
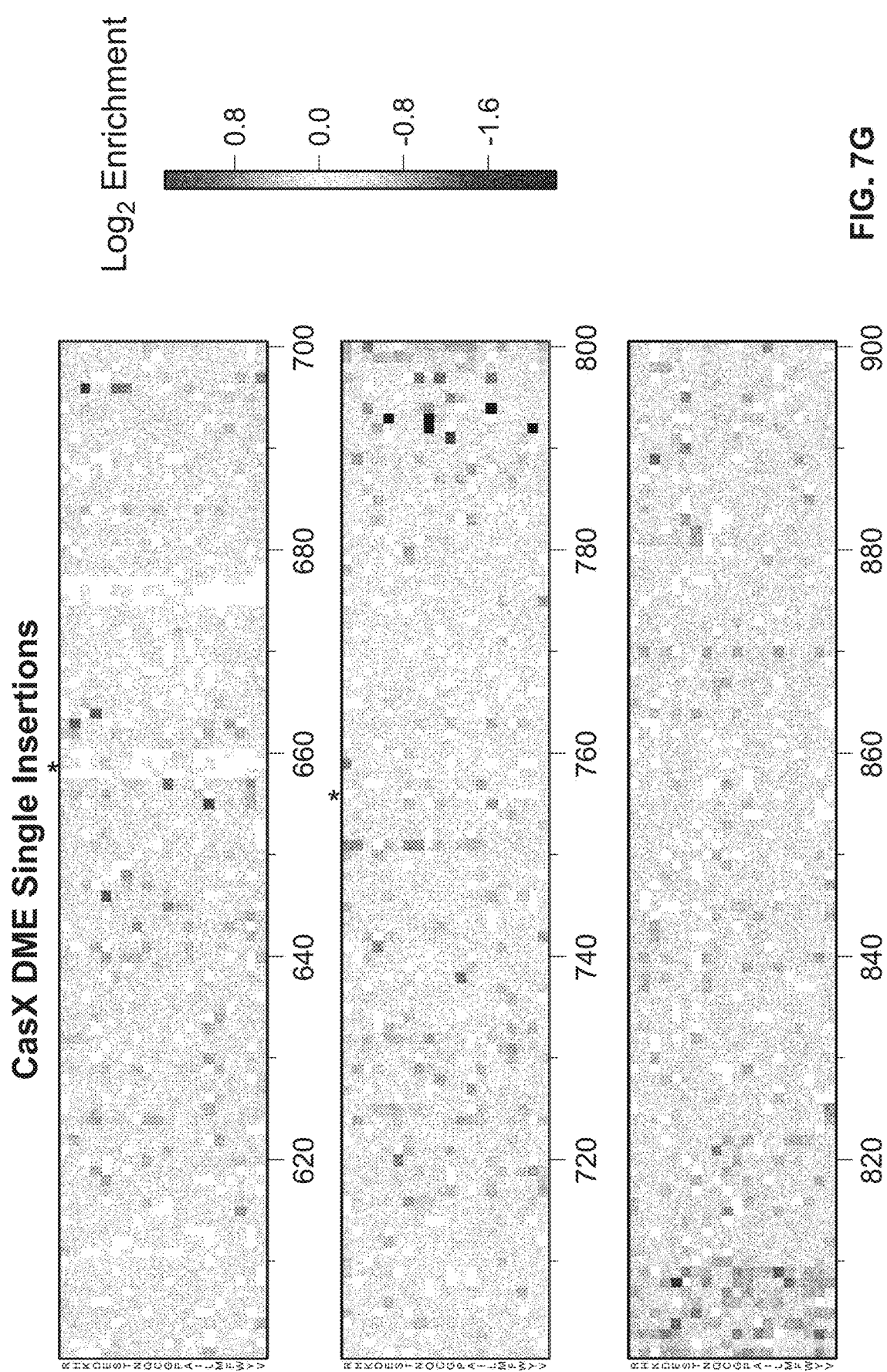
Figure 7H:
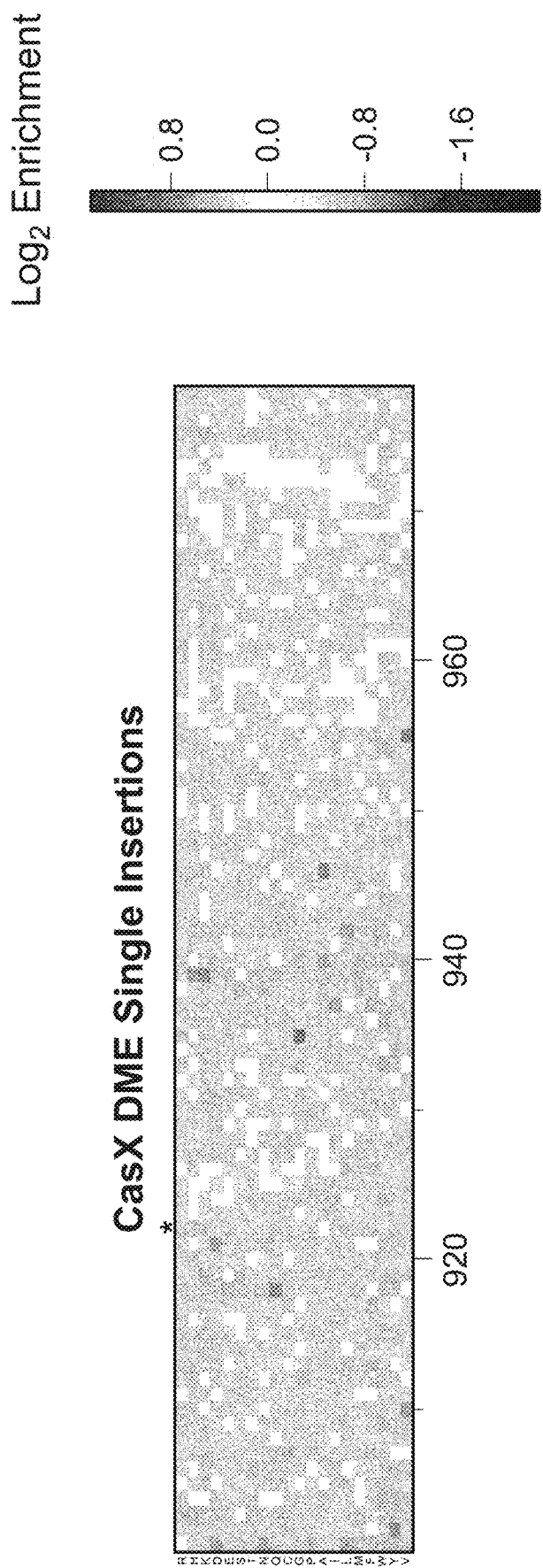
Figure 7I:
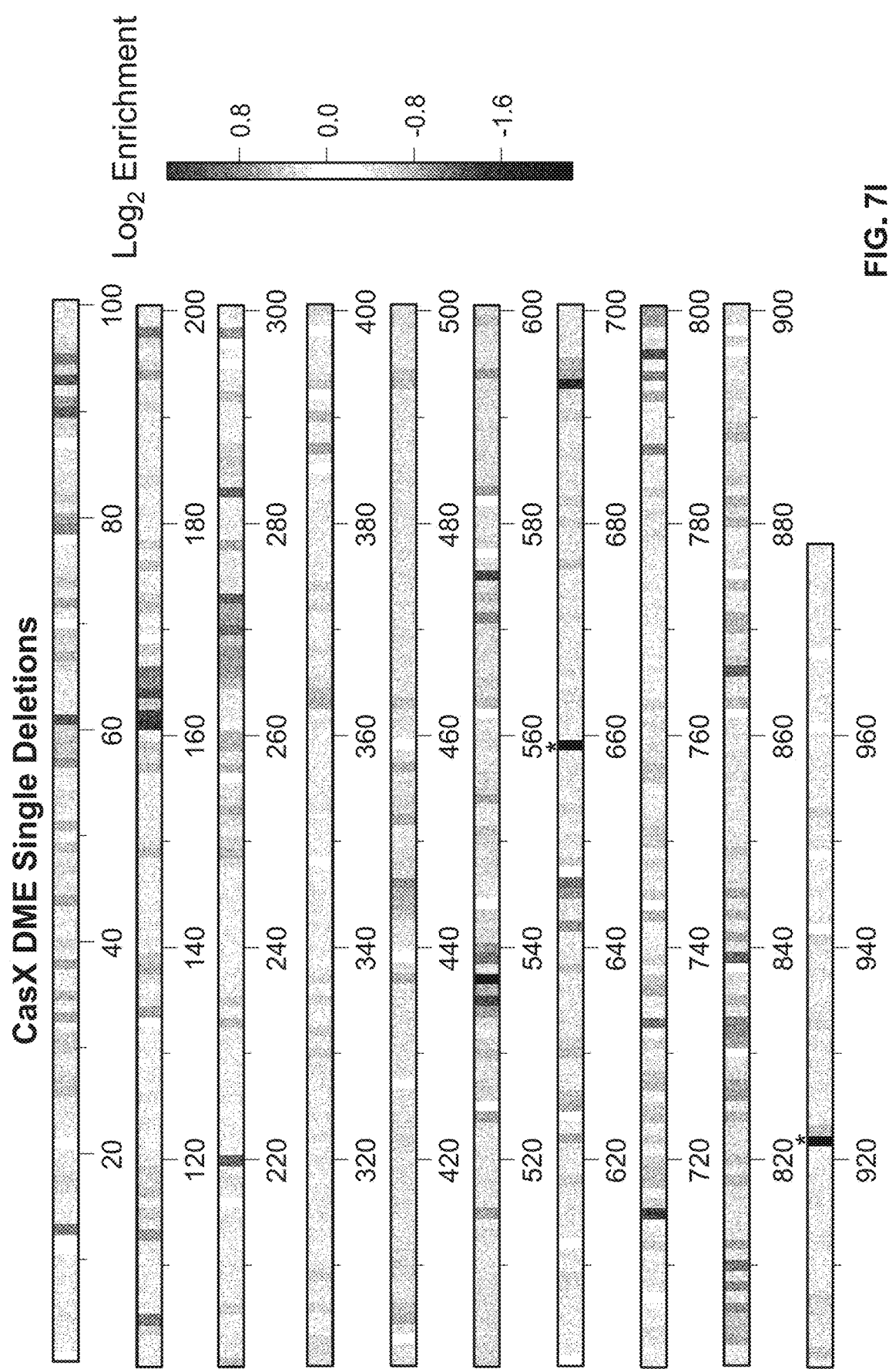

Activity of select sgRNA variants generated by DME and rational engineering is shown in FIGS. 5A-5E, mean change in activity is shown in Table 6, and sgRNA variant sequences are provided in Table 2. sgRNA variants with increased activity were tested in HEK293 cells as described in Example 1. FIG. 5C shows that select sgRNA variant have improved GFP editing when assayed in HEK293 cells. FIG. 5D shows that in some cases, activity can be improved by appending ribozyme sequences. FIG. 5E shows that sgRNA variants comprising combinations of changes, for example those generated by DME or replacing stem loop sequences, can further improve editing activity.

Example 4: Mutagenesis of CasX Protein Produces Improved Variants

A selectable, mammalian-expression plasmid was constructed that included a reference, also referred to herein as starting or base, CasX protein sequence, an sgRNA scaffold, and a destination sequence that can be replaced by spacer sequences. In this case, the starting CasX protein was Stx2 (SEQ ID NO: 2), the wild type Planctomycetes CasX sequence and the scaffold was the wild type sgRNA scaffold of SEQ ID NO: 5. This destination plasmid was digested using the appropriate restriction enzyme following manufacturer's protocol. Following digestion, the digested DNA was purified using column purification according to manufacturer's protocol. The E6 and E7 spacer oligos targeting GFP were annealed in 10 uL of annealing buffer. The annealed oligos were ligated to the purified digested backbone using a Golden Gate ligation reaction. The Golden Gate ligation product was transformed into chemically competent *E. coli* bacterial cells and plated onto LB agar plates with the appropriate antibiotic. Individual colonies were picked, and the GFP spacer insertion was verified via Sanger sequencing.

The following methods were used to construct a DME library of CasX protein variants. The functional Plm CasX protein, which is a 978 residue multi-domain protein (SEQ ID NO: 2) can function in a complex with a 108 bp sgRNA scaffold (SEQ ID NO: 5), with an additional 3' 20 bp variable spacer sequence, which confers DNA binding specificity. Construction of the comprehensive mutation library thus required two methods: one for the protein, and one for the sgRNA. Plasmid recombineering was used to construct a DME protein library of CasX protein variants. PCR-based mutagenesis was used to construct an RNA library of the sgRNA. Importantly, the DME approach can make use of a variety of molecular biology techniques. The techniques used for genetic library construction can be variable, while the design and scope of mutations encompasses the DME method.

In designing DME mutations for the reference CasX protein, synthetic oligonucleotides were constructed as follows: for each codon, three types of oligonucleotides were synthesized. First, the substitution oligonucleotide replaced the three nucleotides of the codon with one of 19 possible alternative codons which code for the 19 possible amino acid mutations. 30 base pair flanking regions of perfect homology to the target gene allow programmable targeting of these mutations. Second, a similar set of 20 synthetic oligonucleotides encoded the insertion of single amino acids. Here, rather than replace the codon, a new region consisting of three base pairs was inserted between the codon and the flanking homology region. Twenty different sets of three nucleotides were inserted, corresponding to new codons for each of the twenty amino acids. Larger insertions can be built identically but will contain an additional three, six, or nine base pairs, encoding all possible combinations of two, three, or four amino acids. Third, an oligonucleotide was designed to remove the three base pairs comprising the codon, thus deleting the amino acid. As above, oligonucleotides can be designed to delete one, two, three, or four amino acids. Plasmid recombineering was then used to recombine these synthetic mutations into a target gene of interest, however other molecular biology methods can be used in its place to accomplish the same goal.

Table 6 shows the fold enrichment of CasX protein variant DME libraries created from the reference protein of SEQ ID NO: 2, which were then subjected to DME selection/screening processes.

In Table 6 below, the read counts associated with each of the listed variants was determined. Each variant was defined by its position (0-indexed), reference base, and alternate base. Only sequences with at least 10 reads (summed) across samples were analyzed, to filter from 457K variants to 60K variants. An insertion at position i indicates an inserted base between position i−1 and i (i.e. before the indicated position). 'counts' indicates the sequencing-depth normalized read count per sequence per sample. Technical replicates were combined by taking the geometric mean. 'log 2enrichment' gives the median enrichment (using a pseudocount of 10) across each context, or across all samples, after merging for technical replicates. Each context was normalized by its own naive sample. Finally, the 'log 2enrichment_err' gives the 'confidence interval' on the mean log 2 enrichment. It is the std. deviation of the enrichment across samples *2/sqrt of the number of samples. Below, only the sequences with median log 2enrichment−log 2enrichment_err>0 are shown (60274 sequences examined).

The computational protocol used to generate Table 6 was as follows: each sample library was sequenced on an Illumina HiSeq™ for 150 cycles paired end (300 cycles total). Reads were trimmed to remove adapter sequences, and aligned to a reference sequence. Reads were filtered if they did not align to the reference, or if the expected number of errors per read was high, given the phred base quality scores. Reads that aligned to the reference sequence, but did not match exactly, were assessed for the protein mutation that gave rise to the mismatch, by aligning the encoded protein sequence of the read to the protein sequence of the reference at the aligned location. Any consecutive variants were grouped into one variant that extended multiple residues. The number of reads that support any given variant was determined for each sample. This raw variant read count per sample was normalized by the total number of reads per sample (after filtering for low expected number of errors per read, given the phred quality scores) to account for different sequencing depths. Technical replicates were combined by finding the geometric mean of variant normalized read count (shown below, 'counts'). Enrichment was calculated for each sample by diving by the naive read count (with the same context—i.e. D2, D3, DDD). To downweight the enrichment associated with low read count, a pseudocount of 10 was added to the numerator and denominator during the enrichment calculation. The enrichment for each context is the median across the individual gates, and the enrichment overall is the median enrichment across the gates and contexts. Enrichment error is the standard deviation of the log 2 enrichment values, divided by the sqrt of the number of values per variant, multiplied by 2 to make a 95% confidence interval on the mean.

Figure 8A:
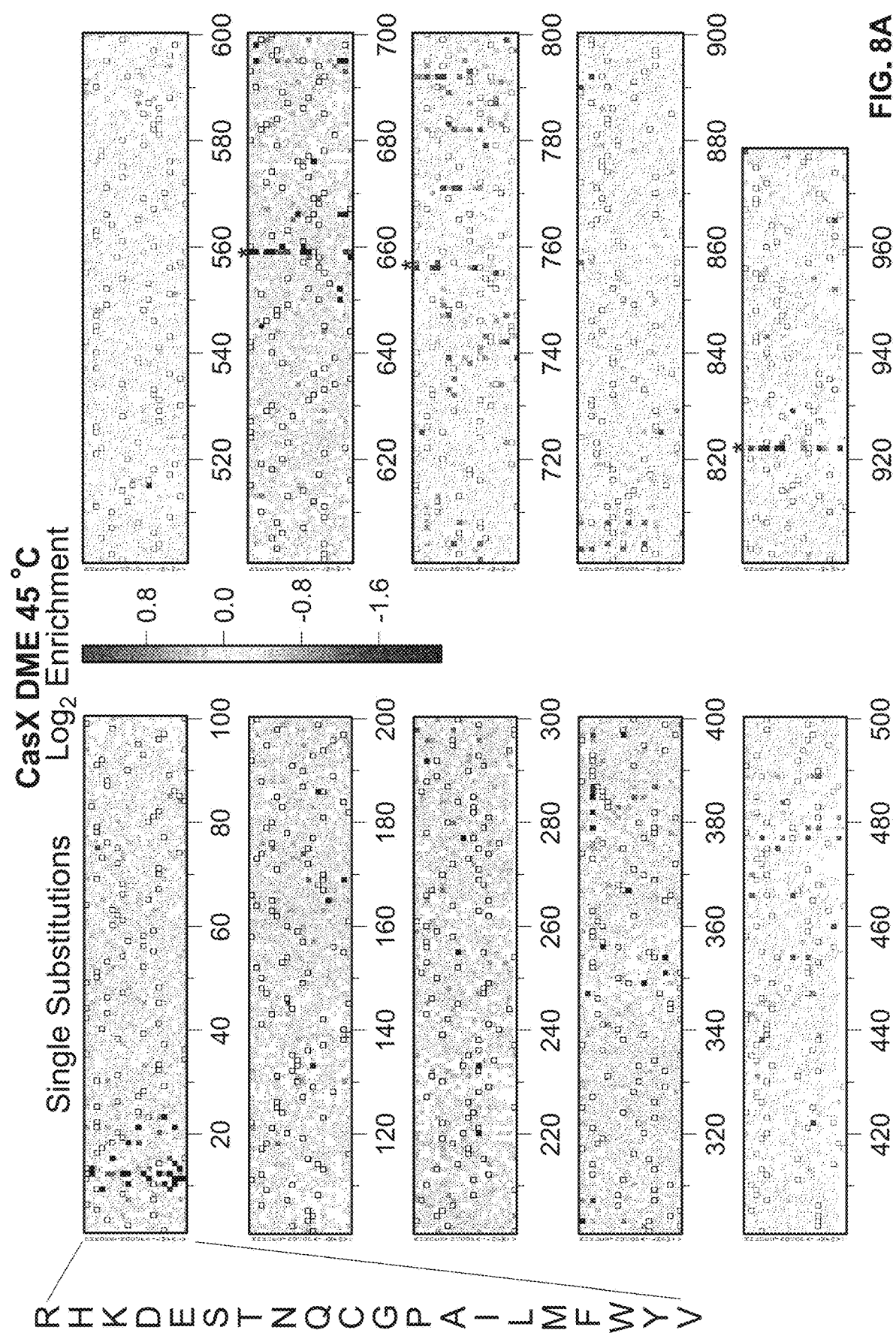
FIGS. 8A-8C are a series of heat maps showing the effect of single amino acid substitutions, single amino acid insertions and deletions at each amino acid position in a reference CasX protein of SEQ ID NO: 2, as described in Example 4. Data were generated by a DME assay run at 45° C.
Figure 8B:
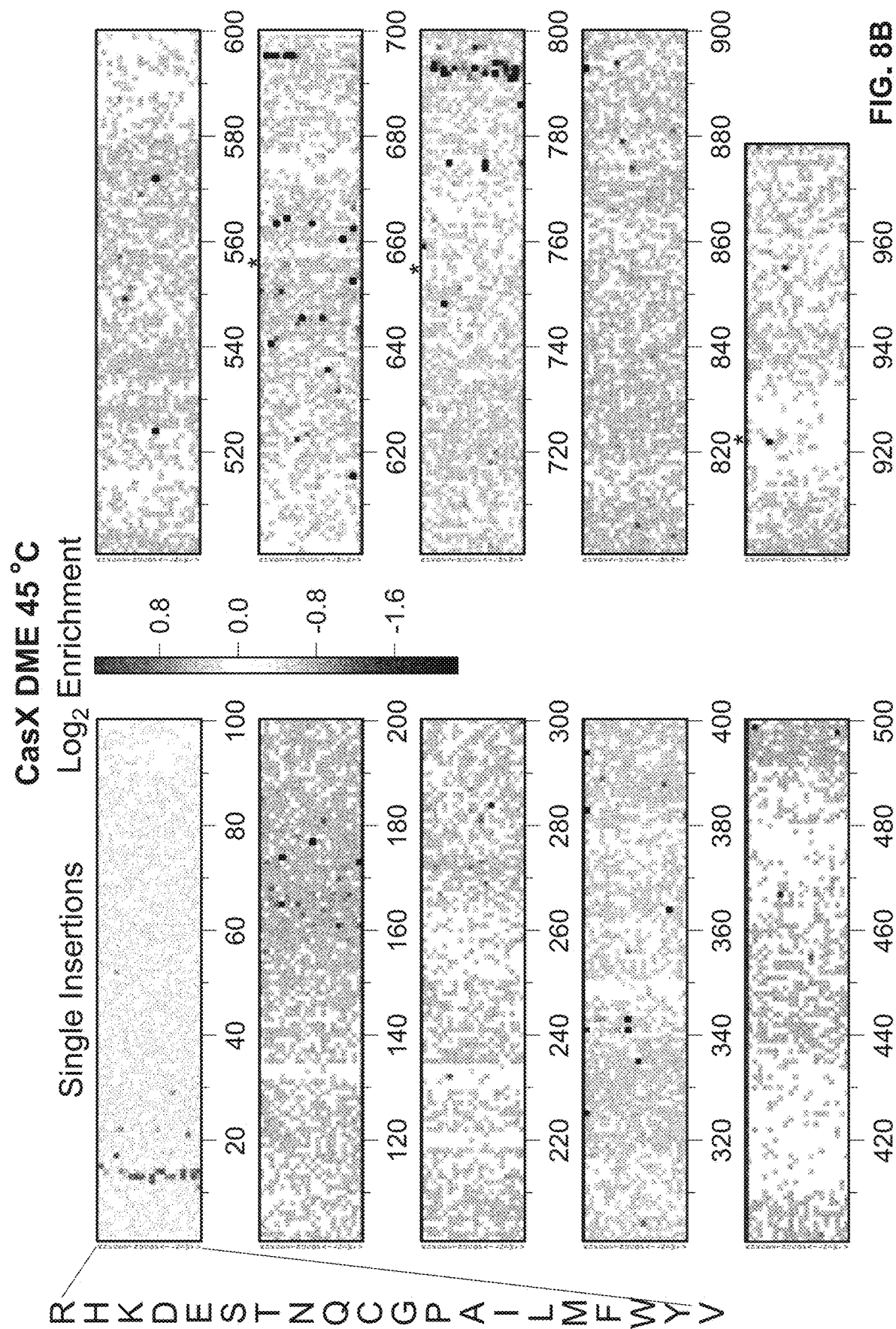
Figure 8C:
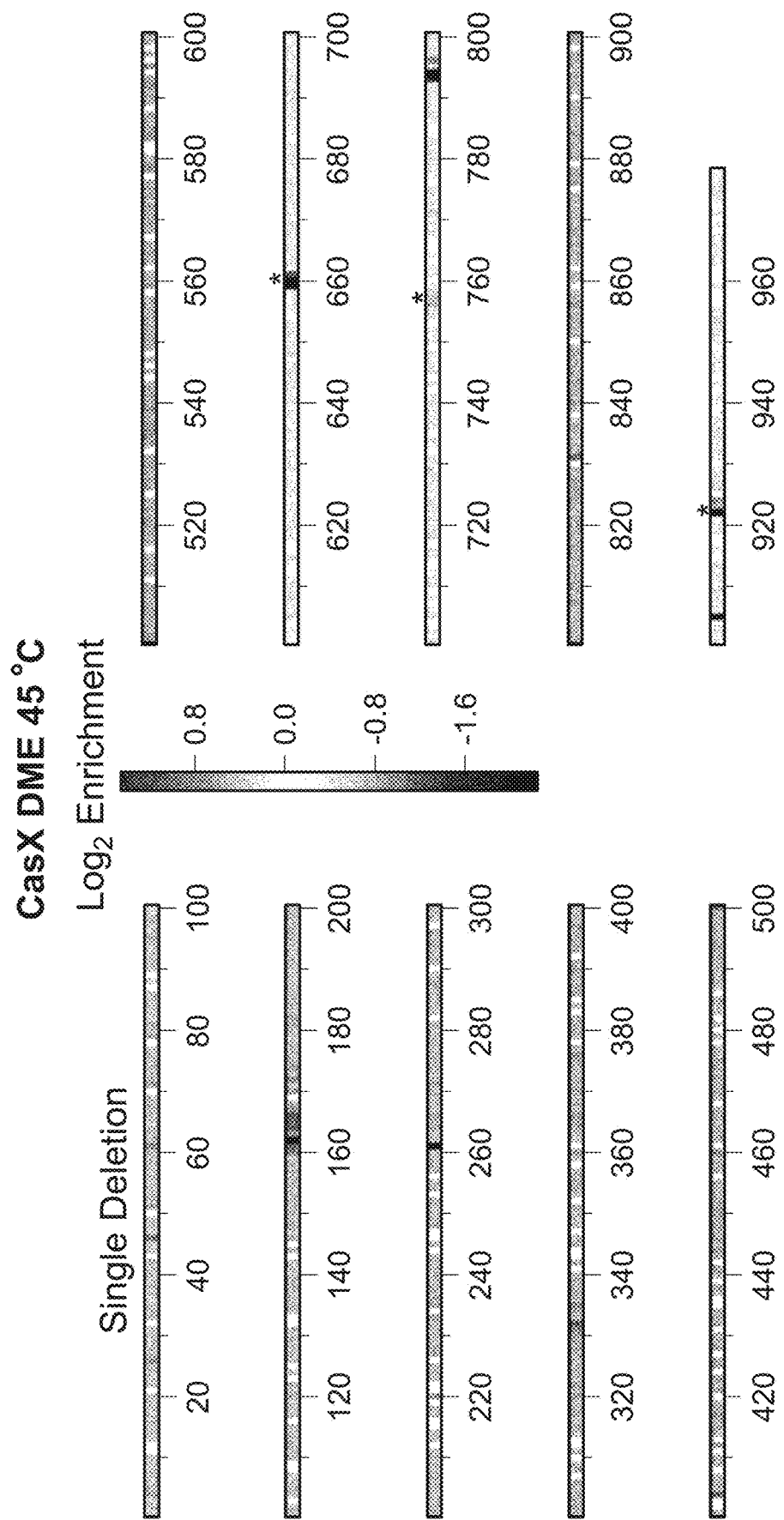
Figure 9:
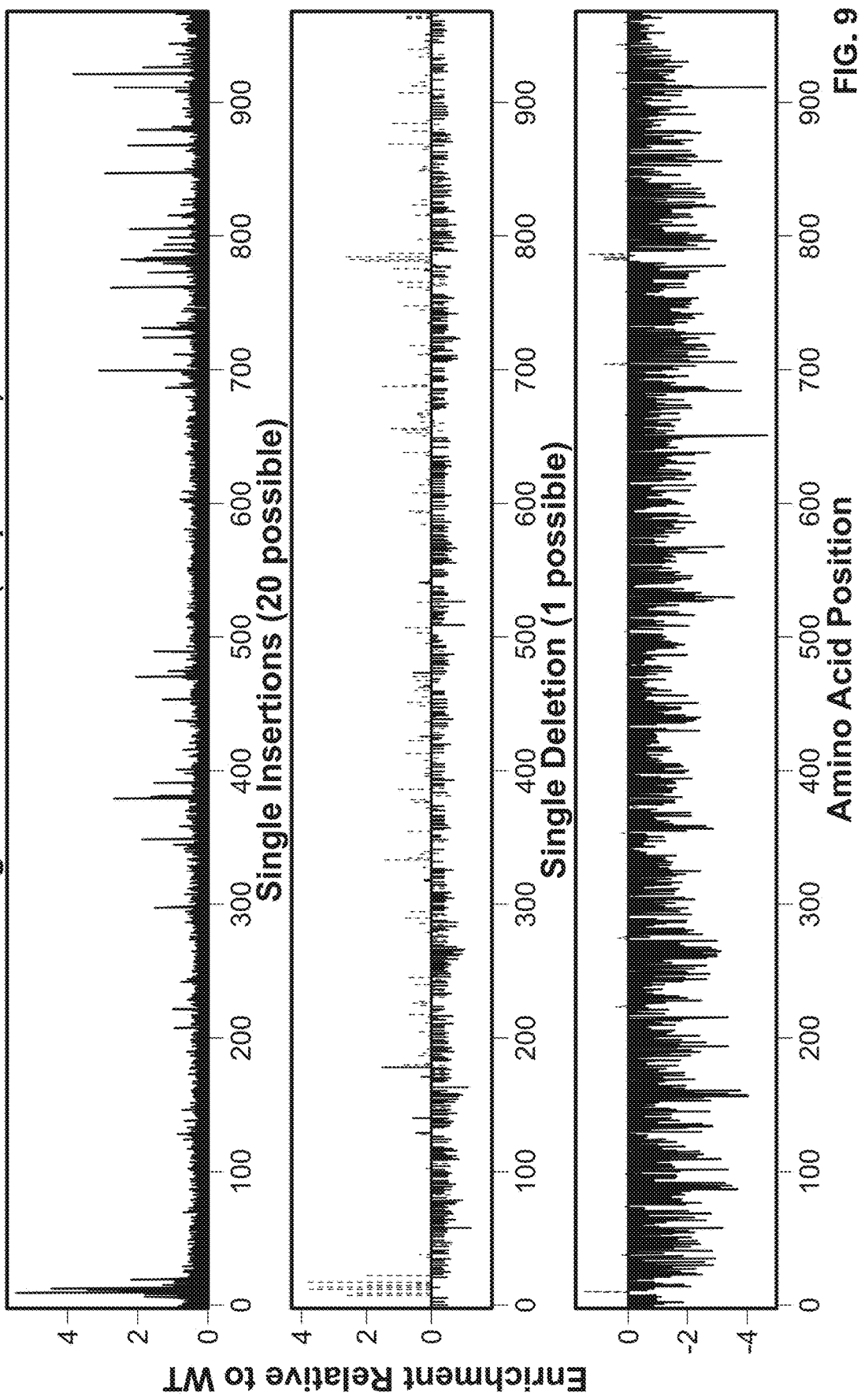
FIG. 9 shows a survey of the comprehensive mutational landscape of all single mutations of a reference CasX protein of SEQ ID NO: 2. On the Y-axis, fold enrichment of CasX variants relative to the reference CasX protein for single substitutions (top), single insertions (middle) or single deletions (bottom). On the X-axis, amino acid position in the reference CasX protein. Key regions that yield improved CasX variants are the initial helix region and regions in the RuvC domain bordering the target strand loading (TLS) domain, as well as others.

Heat maps of DME variant enrichment for each position of the reference CasX protein are shown in FIGS. 7A-7I and FIGS. 8A-8C. Fold enrichment of DME variants with single substitutions, insertions and deletions of each amino acid of the reference CasX protein of SEQ ID NO: 2 are shown. FIGS. 7A-7I and Table 6 summarize the results when the DME experiment was run at 37° C. FIGS. 8A-8C summarize the results when the same experiment was run at 45° C. A comparison of the data in FIGS. 7A-7I and FIGS. 8A-8C shows that running the same assay at two temperatures enriches for different variants. A comparison of the two temperatures thus indicates which amino acid residues and changes are important for thermostability and folding, and these amino acids can then be targeted to produce CasX protein variants with improved thermostability and folding.

TABLE 6

Fold enrichment of CasX DME Variants

| Pos. | Ref. | Alt. | Med. Enrich. | 95% CI |
|---|---|---|---|---|
| 11 | R | N | 3.123689614 | 1.666090155 |
| 13 | — | AS | 2.772897791 | 0.812692873 |
| 13 | — | AG | 2.740825108 | 1.138556052 |
| 12 | — | V | 2.739405927 | 1.743064315 |
| 13 | — | TS | 2.69239793 | 1.005397595 |
| 12 | — | Y | 2.676525308 | 1.621386271 |
| 754 | FE | LA | 2.638126094 | 0.709679147 |
| 13 | — | L | 2.63160466 | 1.131924801 |
| 14 | V | S | 2.616515776 | 1.515637887 |
| 877 | V | G | 2.558943878 | 1.132565008 |
| 21 | — | D | 2.295527175 | 0.893253582 |
| 12 | — | PG | 2.222956581 | 1.243693989 |
| 824 | V | M | 2.181465681 | 1.137291381 |
| 12 | — | Q | 2.102167857 | 1.396704669 |
| 13 | L | E | 2.049540302 | 0.886997965 |
| 12 | R | A | 2.046419725 | 1.229773759 |
| 889 | S | K | 2.030682939 | 0.721857305 |
| 791 | — | Q | 1.996189679 | 0.799796529 |
| 21 | — | S | 1.907167641 | 0.736834562 |

TABLE 6-continued

Fold enrichment of CasX DME Variants

| Pos. | Ref. | Alt. | Med. Enrich. | 95% CI |
|---|---|---|---|---|
| 14 | — | A | 1.89090961 | 1.25865759 |
| 11 | R | M | 1.88125645 | 0.779897343 |
| 856 | Y | R | 1.83253552 | 0.74976479 |
| 707 | A | Q | 1.830052571 | 0.555234229 |
| 16 | — | D | 1.826796594 | 1.168291076 |
| 17 | S | G | 1.799890039 | 0.536675637 |
| 931 | S | M | 1.798321904 | 1.171026479 |
| 13 | L | V | 1.782912682 | 0.513630591 |
| 11 | — | AS | 1.782444935 | 0.75642805 |
| 856 | Y | K | 1.748619552 | 0.651026121 |
| 796 | — | AS | 1.742437726 | 0.859039085 |
| 877 | V | D | 1.738762289 | 0.688664606 |
| 459 | K | W | 1.696823829 | 0.67904004 |
| 891 | E | K | 1.6928634 | 0.819015932 |
| 9 | — | T | 1.667698181 | 0.626564384 |
| 19 | — | R | 1.664532235 | 0.885325268 |
| 11 | R | P | 1.655382042 | 1.234907956 |
| 793 | — | L | 1.585086754 | 0.91714318 |
| 931 | S | L | 1.583295371 | 0.643295534 |
| 12 | — | AG | 1.580094246 | 1.037517499 |
| 770 | M | P | 1.577648056 | 1.061356917 |
| 791 | L | E | 1.551380949 | 0.823309399 |
| 21 | — | A | 1.542633652 | 0.760237264 |
| 814 | F | H | 1.510927821 | 0.672796928 |
| 12 | — | C | 1.506305374 | 0.730799624 |
| 791 | L | S | 1.505731571 | 0.598349327 |
| 792 | — | AS | 1.474378912 | 0.833339427 |
| 12 | — | L | 1.46896091 | 0.783746198 |
| 795 | T | — | 1.465811841 | 0.744738295 |
| 792 | — | Q | 1.462809015 | 0.586506727 |
| 11 | R | S | 1.459875087 | 0.740946571 |
| 11 | R | T | 1.450818176 | 0.908088492 |
| 738 | A | V | 1.397545277 | 0.638310372 |
| 791 | — | Y | 1.382702158 | 0.877495368 |
| 384 | E | P | 1.36783963 | 0.775382596 |
| 793 | — | ST | 1.351743597 | 0.608183464 |
| 738 | A | T | 1.349932545 | 0.581386051 |
| 781 | W | Q | 1.342276465 | 0.719454459 |
| 17 | — | G | 1.340746587 | 0.878053267 |
| 12 | — | AS | 1.333635165 | 1.19716917 |
| 771 | A | V | 1.292995852 | 0.871463205 |
| 792 | — | E | 1.290525566 | 1.195462062 |
| 921 | A | M | 1.28763891 | 0.560591034 |
| 979 | LE[stop]GS- | VSSKDL (SEQ ID NO: 3664) | 1.282505495 | 0.371661154 |
| 770 | M | Q | 1.279910431 | 1.186538897 |
| 16 | — | AG | 1.271874994 | 0.55951096 |
| 384 | E | N | 1.247124467 | 0.607911368 |
| 979 | L- | VS | 1.239823793 | 0.315337927 |
| 979 | LE[stop] | VSS | 1.233215135 | 0.36262523 |
| 658 | -D | APG | 1.220851584 | 0.979760686 |
| 979 | L-E | VSS | 1.21568584 | 0.37106558 |
| 385 | E | S | 1.210243487 | 0.826999735 |
| 979 | LE[stop]GS-PGIK (SEQ ID NO: 3665)[stop] | VSSKDLQASNK (SEQ ID NO: 3666) | 1.208612972 | 0.286427519 |
| 793 | — | SA | 1.192367811 | 0.72089465 |
| 739 | R | A | 1.188987234 | 0.611670208 |
| 795 | — | AS | 1.183930928 | 0.90542554 |
| 979 | LE[stop]GS-P | VSSKDLQ (SEQ ID NO: 3667) | 1.180100725 | 0.35995062 |
| 977 | V | K | 1.17977084 | 0.720108501 |
| 658 | -D | AAS | 1.173300666 | 0.50353561 |
| 14 | — | TS | 1.173232132 | 0.700156049 |
| 10 | — | V | 1.164019233 | 1.085055677 |
| 375 | P | K | 1.163918709 | 0.891802018 |
| 795 | — | AG | 1.14629929 | 0.481029275 |
| 979 | LE[stop]GSPG (SEQ ID NO: 3668) | VSSKDLQ (SEQ ID NO: 3667) | 1.143633475 | 0.340695621 |
| 979 | LE | VS | 1.142516835 | 0.386398408 |
| 877 | V | Q | 1.141917178 | 0.655790093 |
| 979 | L-E[stop] | VSSK (SEQ ID NO: 3669) | 1.125229136 | 0.372301096 |

TABLE 6-continued

Fold enrichment of CasX DME Variants

| Pos. | Ref. | Alt. | Med. Enrich. | 95% CI |
|---|---|---|---|---|
| 936 | R | Q | 1.117866436 | 0.745233062 |
| 979 | LE[stop]GS-PGIK (SEQ ID NO: 3665) | VSSKDLOASN (SEQ ID NO: 3670) | 1.111969193 | 0.311410682 |
| 396 | V | Q | 1.105278825 | 0.646150998 |
| 979 | LE[stop]GSP | VSSKDL (SEQ ID NO: 3664) | 1.104849849 | 0.260693612 |
| 353 | L | F | 1.103922948 | 0.510520582 |
| 979 | LE[stop]GS-PG (SEQ ID NO: 3668) | VSSKDLQA (SEQ ID NO: 3671) | 1.100880851 | 0.345695892 |
| 697 | Y | H | 1.097977697 | 0.419010874 |
| 796 | — | PG | 1.095168865 | 0.816765224 |
| 4 | — | TS | 1.088089915 | 0.693109756 |
| 10 | R | K | 1.085472062 | 0.382234839 |
| 790 | G | M | 1.066566819 | 0.686227232 |
| 921 | A | K | 1.056315246 | 0.70226115 |
| 696 | — | R | 1.049001055 | 0.880941583 |
| 9 | | L | 1.039309233 | 0.528320595 |
| 979 | LE[stop]GSPGIK (SEQ ID NO: 3672)[stop]N | VSSKDLQASNK (SEQ ID NO: 3666) | 1.037884742 | 0.299531766 |
| 13 | — | S | 1.031062599 | 0.727357338 |
| 384 | E | R | 1.028117481 | 0.683537724 |
| 21 | K | D | 1.019445543 | 0.748518701 |
| 978 | [stop] | G | 1.016498062 | 0.514955543 |
| 979 | L-E[stop]G | VSSKD (SEQ ID NO: 3673) | 1.016126075 | 0.353515679 |
| 10 | R | N | 1.010184099 | 0.846798556 |
| 794 | — | PG | 1.00924007 | 0.987312969 |
| 791 | L | Q | 1.004388299 | 0.361910793 |
| 792 | P | G | 1.002325281 | 0.805296973 |
| 877 | V | C | 0.995089773 | 0.566724231 |
| 476 | C | Y | 0.984546648 | 0.686487573 |
| 19 | — | PG | 0.984071689 | 0.738694244 |
| 979 | LE[stop]GSPGI (SEQ ID NO: 3674) | VSSKDLQA (SEQ ID NO: 3671) | 0.972011014 | 0.292930615 |
| 752 | L | P | 0.971338521 | 0.459371253 |
| 12 | R | C | 0.969988229 | 0.745286116 |
| 12 | R | Y | 0.962112567 | 0.714384629 |
| 979 | LE[stop]GSPGIK (SEQ ID NO: 3672) | VSSKDLQAS (SEQ ID NO: 3675) | 0.960035296 | 0.298173201 |
| 18 | — | PG | 0.952532997 | 0.782330584 |
| 778 | M | I | 0.945963409 | 0.345538178 |
| 798 | S | P | 0.942103893 | 0.470224487 |
| 16 | D | G | 0.941159649 | 0.341870864 |
| 22 | A | Q | 0.937573643 | 0.676316271 |
| 754 | FE | IA | 0.935796963 | 0.660936674 |
| 1 | Q | K | 0.935474248 | 0.373656765 |
| 14 | V | F | 0.932689058 | 0.742246472 |
| 8 | K | I | 0.928472117 | 0.521050669 |
| 384 | E | G | 0.920571639 | 0.452302777 |
| 732 | D | T | 0.912254061 | 0.759438627 |
| 658 | D | Y | 0.894131769 | 0.312165116 |
| 211 | L | P | 0.887315174 | 0.318877781 |
| 14 | V | A | 0.885138345 | 0.699864156 |
| 979 | LE[stop]G | V-S | 0.88.4897395 | 0.252782429 |
| 13 | — | | 0.883212774 | 0.713984249 |
| 979 | LE[stop]G | VSSK (SEQ ID NO: 3669) | 0.881127427 | 0.417135617 |
| 386 | D | K | 0.879045429 | 0.728272074 |
| 5 | R | I | 0.871114116 | 0.317513506 |
| 660 | — | AS | 0.862493953 | 0.798632847 |
| 877 | V | M | 0.855677916 | 0.267740831 |
| 741 | L | W | 0.851844349 | 0.594072278 |
| 24 | — | W | 0.835220929 | 0.745009807 |
| 755 | E | [stop] | 0.833955657 | 0.31600491 |
| 928 | I | T | 0.832425124 | 0.307759846 |
| 979 | LE[stop]GS-PGI (SEQ ID NO: 3674) | VSSKDLQAS (SEQ ID NO: 3675) | 0.822335062 | 0.317179456 |
| 781 | W | K | 0.810589018 | 0.686153856 |
| 791 | L | R | 0.806201856 | 0.611654466 |

TABLE 6-continued

Fold enrichment of CasX DME Variants

| Pos. | Ref. | Alt. | Med. Enrich. | 95% CI |
|---|---|---|---|---|
| 979 | LE[stop]GSPGIK (SEQ ID NO: 3672)[stop] | VSSKDLQASN (SEQ ID NO: 3670) | 0.80600706 | 0.220866187 |
| 711 | E | Q | 0.793874739 | 0.38732268 |
| 703 | T | N | 0.791134752 | 0.735228799 |
| 793 | S | — | 0.7821232 | 0.523699668 |
| 385 | E | K | 0.781091846 | 0.579724424 |
| 955 | R | M | 0.780963169 | 0.340474646 |
| 469 | — | N | 0.775656135 | 0.541879732 |
| 788 | V | T | 0.770125047 | 0.581859138 |
| 705 | Q | R | 0.76633283 | 0.261069709 |
| 9 | — | TS | 0.763723778 | 0.674640849 |
| 979 | LE[stop]GS | VSSKD (SEQ ID NO: 3673) | 0.761764547 | 0.205465156 |
| 715 | A | K | 0.761122086 | 0.540516283 |
| 384 | E | K | 0.760859162 | 0.22641046 |
| 591 | QG | R- | 0.757963418 | 0.374903235 |
| 316 | R | M | 0.757086682 | 0.310302995 |
| 770 | M | T | 0.753193128 | 0.319236781 |
| 384 | E | Q | 0.752976137 | 0.602376709 |
| 17 | S | E | 0.752400908 | 0.414988963 |
| 755 | E | D | 0.74863141 | 0.212934852 |
| 12 | R | — | 0.743504623 | 0.648509511 |
| 938 | Q | E | 0.741570425 | 0.469451701 |
| 657 | I | V | 0.73806027 | 0.256874713 |
| −1 | S | T | 0.735179004 | 0.144429929 |
| 2 | E | [stop] | 0.734071396 | 0.323713248 |
| 384 | E | A | 0.733775595 | 0.660142332 |
| 891 | E | Y | 0.733458673 | 0.165192765 |
| 643 | V | F | 0.732765961 | 0.577614171 |
| 796 | — | C | 0.732364738 | 0.485790322 |
| 280 | L | M | 0.731787266 | 0.258239226 |
| 695 | — | K | 0.730902961 | 0.509205112 |
| 343 | W | L | 0.725824372 | 0.292120452 |
| 3 | — | IKRINK (SEQ ID NO: 3676) | 0.721338414 | 0.470264314 |
| 732 | D | N | 0.71945188 | 0.416870981 |
| 687 | — | PTH | 0.716433371 | 0.159856315 |
| 176 | A | D | 0.71514177 | 0.206626688 |
| 485 | W | L | 0.713411462 | 0.238105577 |
| 22 | A | D | 0.710738042 | 0.32510753 |
| 193 | L | P | 0.709349304 | 0.242633498 |
| 899 | R | M | 0.707875506 | 0.298429738 |
| 886 | KG | R- | 0.706803824 | 0.286241441 |
| 796 | — | TS | 0.697218521 | 0.492426198 |
| 329 | P | H | 0.696817542 | 0.314817482 |
| 273 | L | P | 0.696199602 | 0.349703999 |
| 31 | L | M | 0.696080627 | 0.331245769 |
| 645 | — | E | 0.692307595 | 0.590013131 |
| 9 | I | Y | 0.689813642 | 0.667593375 |
| 9 | I | N | 0.688953393 | 0.257809633 |
| 919 | H | R | 0.688781806 | 0.363439859 |
| 687 | P | H | 0.684782236 | 0.310607479 |
| 332 | P | H | 0.672484781 | 0.326219913 |
| 796 | — | N | 0.672333697 | 0.64437503 |
| 421 | W | L | 0.667702097 | 0.291970479 |
| 875 | E | [stop] | 0.66617872 | 0.287006304 |
| 378 | L | K | 0.664474618 | 0.393361359 |
| 891 | E | Q | 0.663650921 | 0.312291932 |
| 926 | L | M | 0.661737644 | 0.525550321 |
| 656 | G | C | 0.659813316 | 0.293973226 |
| 4 | K | N | 0.656251908 | 0.302190904 |
| 774 | Q | E | 0.654737733 | 0.134116674 |
| −1 | S | C | 0.652333059 | 0.118222939 |
| 21 | — | AS | 0.651563705 | 0.48650799 |
| 185 | L | P | 0.649897837 | 0.225081568 |
| 38 | P | T | 0.648698083 | 0.350485275 |
| 936 | R | H | 0.648045448 | 0.423309347 |
| 813 | G | C | 0.644003475 | 0.310838653 |
| 786 | L | M | 0.643153738 | 0.314936636 |
| 942 | K | N | 0.639528926 | 0.249553292 |
| 293 | Y | H | 0.636816244 | 0.207205991 |
| 542 | F | L | 0.635949082 | 0.181128276 |
| 303 | W | L | 0.635588216 | 0.261903568 |
| 979 | LE | V[stop] | 0.635165807 | 0.329009453 |
| 578 | P | H | 0.634392073 | 0.324298942 |

TABLE 6-continued

Fold enrichment of CasX DME Variants

| Pos. | Ref. | Alt. | Med. Enrich. | 95% CI |
|---|---|---|---|---|
| 687 | — | PT | 0.633217575 | 0.355316701 |
| 886 | K | N | 0.632562679 | 0.231080349 |
| 20 | K | R | 0.632186797 | 0.237509121 |
| 248 | L | P | 0.631068881 | 0.180279623 |
| 18 | N | S | 0.630660766 | 0.266585824 |
| 836 | M | V | 0.630065132 | 0.266534124 |
| 116 | K | N | 0.629540403 | 0.234219411 |
| 847 | EG | GA | 0.628295048 | 0.299740787 |
| 912 | L | P | 0.627137425 | 0.187179246 |
| 92 | P | H | 0.626243107 | 0.350245614 |
| 299 | Q | K | 0.623386276 | 0.302029469 |
| 707 | A | T | 0.622086487 | 0.275515174 |
| 669 | L | M | 0.620453868 | 0.351072046 |
| 789 | E | D | 0.617920878 | 0.216264385 |
| 916 | F | S | 0.617302977 | 0.309372822 |
| 55 | P | H | 0.616365993 | 0.329695842 |
| 936 | R | G | 0.615282844 | 0.189389227 |
| 595 | F | L | 0.615176885 | 0.154670433 |
| 0 | M | I | 0.612039515 | 0.303853593 |
| 381 | L | R | 0.609889042 | 0.420808291 |
| 945 | T | A | 0.609683347 | 0.258353939 |
| 389 | K | N | 0.609647876 | 0.274048697 |
| 755 | E | G | 0.607714844 | 0.078377344 |
| 559 | I | M | 0.606040482 | 0.27336203 |
| 825 | L | P | 0.604240507 | 0.192490062 |
| 733 | M | T | 0.603960776 | 0.340233556 |
| 664 | P | T | 0.60370266 | 0.234348448 |
| 10 | R | T | 0.602483957 | 0.372156893 |
| 964 | F | L | 0.60175279 | 0.17004436 |
| 911 | C | S | 0.601303891 | 0.279730674 |
| 788 | Y | G | 0.600935917 | 0.580949772 |
| 447 | Q | K | 0.600543047 | 0.297568309 |
| 13 | L | P | 0.599989903 | 0.236688663 |
| 193 | L | M | 0.599332216 | 0.309308194 |
| 114 | P | H | 0.599262194 | 0.344450733 |
| 660 | G | R | 0.599221963 | 0.319640645 |
| 894 | S | T | 0.599084973 | 0.166490359 |
| 904 | P | H | 0.59783828 | 0.349.499416 |
| 782 | L | T | 0.595786463 | 0.513346845 |
| 944 | Q | K | 0.595243666 | 0.351818545 |
| 207 | P | H | 0.595218482 | 0.277632613 |
| 151 | H | N | 0.595188624 | 0.277503327 |
| 495 | A | K | 0.594637604 | 0.315764586 |
| −1 | S | P | 0.594582952 | 0.377333364 |
| 480 | L | E | 0.594055289 | 0.432259346 |
| 469 | E | A | 0.594025118 | 0.30338267 |
| 11 | R | G | 0.59320688 | 0.163279008 |
| 85 | W | L | 0.591691074 | 0.2708118 |
| 15 | K | E | 0.587925122 | 0.149546484 |
| 755 | E | K | 0.586636571 | 0.217538569 |
| 337 | Q | R | 0.585098232 | 0.172195554 |
| 877 | V | A | 0.584567684 | 0.258968272 |
| 793 | — | TS | 0.583269098 | 0.45091329 |
| 670 | T | R | 0.582033902 | 0.112618756 |
| 925 | A | P | 0.581907283 | 0.186614282 |
| 659 | R | L | 0.580864225 | 0.319384189 |
| 306 | L | P | 0.578183307 | 0.210431982 |
| 676 | P | Q | 0.577757554 | 0.308473522 |
| 877 | V | E | 0.57724394 | 0.294796776 |
| 19 | T | A | 0.576889973 | 0.198407278 |
| 14 | V | D | 0.574902804 | 0.437270334 |
| 887 | G | Q | 0.574717855 | 0.519529758 |
| 935 | L | V | 0.573813105 | 0.185021716 |
| 961 | W | L | 0.573698555 | 0.253700288 |
| 23 | — | GP | 0.572198674 | 0.570313308 |
| 541 | R | L | 0.571508027 | 0.254421711 |
| 288 | E | D | 0.571482463 | 0.24542675 |
| 742 | L | V | 0.570384839 | 0.3027928 |
| 931 | S | T | 0.570369019 | 0.120673525 |
| 623 | — | RRTRQDE (SEQ ID NO: 3677) | 0.569913903 | 0.141118873 |
| 27 | P | H | 0.569605452 | 0.285015385 |
| 28 | M | T | 0.56885021 | 0.216863369 |
| 907 | E | [stop] | 0.567613159 | 0.345163987 |
| 577 | D | Y | 0.567493308 | 0.253952459 |
| 672 | P | H | 0.566921749 | 0.31335168 |

TABLE 6-continued

Fold enrichment of CasX DME Variants

| Pos. | Ref. | Alt. | Med. Enrich. | 95% CI |
|---|---|---|---|---|
| 669 | L | P | 0.564276636 | 0.224594167 |
| 52 | E | D | 0.564250133 | 0.246311739 |
| 46 | N | T | 0.563094073 | 0.208662987 |
| 5 | R | G | 0.560139309 | 0.15069426 |
| 912 | L | V | 0.559515875 | 0.111973397 |
| 40 | L | M | 0.558605774 | 0.239058063 |
| 923 | Q | [stop] | 0.558515774 | 0.34688202 |
| 979 | L-E[stop]G | VSSKE (SEQ ID NO: 3678) | 0.557263947 | 0.22994802 |
| 41 | R | T | 0.555902565 | 0.199937528 |
| 179 | E | [stop] | 0.555817911 | 0.245362937 |
| 344 | W | L | 0.555474112 | 0.286390208 |
| 63 | R | M | 0.554978749 | 0.336590825 |
| 1 | Q | R | 0.554755158 | 0.207724233 |
| 9 | I | V | 0.554053334 | 0.219348804 |
| 914 | C | [stop] | 0.552658801 | 0.347714953 |
| 836 | M | I | 0.551813626 | 0.180327214 |
| 856 | Y | H | 0.549262192 | 0.369311354 |
| 620 | L | M | 0.548957556 | 0.322210662 |
| 926 | L | P | 0.547714601 | 0.450095044 |
| 377 | L | P | 0.546553821 | 0.20366425 |
| 920 | A | S | 0.545992524 | 0.484867291 |
| 961 | W | [stop] | 0.544371204 | 0.244581668 |
| 746 | V | G | 0.543151726 | 0.512718498 |
| 554 | — | RFY | 0.542549772 | 0.20487223 |
| 664 | P | H | 0.542466431 | 0.281534858 |
| 5 | R | [stop] | 0.541304946 | 0.166704906 |
| 803 | Q | K | 0.540975244 | 0.291121648 |
| 652 | M | I | 0.540953074 | 0.217563311 |
| 326 | KG | R- | 0.540593574 | 0.402287668 |
| 789 | E | [stop] | 0.540122225 | 0.236046287 |
| 889 | S | L | 0.539927241 | 0.375365013 |
| 10 | R | I | 0.539433301 | 0.326816988 |
| 725 | K | N | 0.539088606 | 0.178127049 |
| 603 | L | P | 0.538897648 | 0.229282796 |
| 15 | K | R | 0.538786311 | 0.154390287 |
| 541 | R | G | 0.537572295 | 0.133876643 |
| 632 | L | M | 0.537440995 | 0.246129141 |
| 665 | A | S | 0.536996011 | 0.286216687 |
| 650 | K | E | 0.536939626 | 0.139863469 |
| 932 | W | L | 0.536075206 | 0.314946873 |
| 684 | L | M | 0.535519584 | 0.338883641 |
| 918 | I | R | 0.535067274 | 0.304580877 |
| 10 | R | G | 0.534873359 | 0.3557865 |
| 575 | F | L | 0.534865272 | 0.139851134 |
| 737 | I | G | 0.534759369 | 0.303617666 |
| 907 | E | G | 0.534688762 | 0.240107856 |
| 703 | T | R | 0.53396819 | 0.160757401 |
| 962 | Q | E | 0.533896042 | 0.302336405 |
| 764 | Q | H | 0.53385913 | 0.24340782 |
| 793 | S | T | 0.533306619 | 0.17379091 |
| 6 | I | M | 0.533192185 | 0.188523563 |
| 467 | L | P | 0.533022246 | 0.179464215 |
| 244 | Q | [stop] | 0.532045714 | 0.262393061 |
| 8 | K | N | 0.531704561 | 0.294399975 |
| 508 | F | V | 0.529042378 | 0.192146822 |
| 665 | A | P | 0.529013767 | 0.174049723 |
| 46 | NL | T[stop] | 0.529006897 | 0.272198259 |
| 3 | I | V | 0.528916598 | 0.14506718 |
| 518 | W | S | 0.528332889 | 0.199792834 |
| 792 | P | A | 0.528028079 | 0.112407207 |
| 13 | L | A | 0.526728857 | 0.318983292 |
| 56 | Q | K | 0.526387006 | 0.188452852 |
| 878 | N | S | 0.526073971 | 0.27887921 |
| 213 | Q | E | 0.525578421 | 0.16885346 |
| 748 | Q | H | 0.525406412 | 0.200108279 |
| 15 | K | N | 0.525094369 | 0.273038164 |
| 954 | K | N | 0.524763966 | 0.208680978 |
| 835 | W | L | 0.524725836 | 0.26540236 |
| 847 | E | D | 0.524019387 | 0.23897504 |
| 608 | L | M | 0.523890883 | 0.248052068 |
| 932 | W | R | 0.523129128 | 0.299781077 |
| 21 | K | N | 0.522953217 | 0.250998038 |
| 790 | G | [stop] | 0.5229473 | 0.262740975 |
| 707 | A | D | 0.522560362 | 0.214610237 |
| 954 | K | V | 0.522546614 | 0.349200627 |

TABLE 6-continued

Fold enrichment of CasX DME Variants

| Pos. | Ref. | Alt. | Med. Enrich. | 95% CI |
|---|---|---|---|---|
| 952 | T | A | 0.521534511 | 0.149679645 |
| 892 | A | D | 0.521298872 | 0.228218092 |
| 847 | — | EGQITYY (SEQ ID NO: 3679) | 0.521149636 | 0.115331328 |
| 7 | N | I | 0.521103862 | 0.202836314 |
| 702 | R | M | 0.520743818 | 0.247227864 |
| 901 | S | G | 0.520379757 | 0.143482219 |
| 560 | N | H | 0.519240936 | 0.286066696 |
| 350 | V | M | 0.518159753 | 0.277778553 |
| 535 | F | L | 0.518099748 | 0.153008763 |
| 512 | Y | H | 0.517168474 | 0.223506594 |
| 278 | I | M | 0.516794992 | 0.238648894 |
| 746 | V | A | 0.51672383 | 0.202625874 |
| 664 | P | R | 0.516702968 | 0.252959416 |
| −1 | S | A | 0.516689693 | 0.142459137 |
| 298 | A | D | 0.51645727 | 0.257163483 |
| 361 | G | C | 0.515521808 | 0.242033529 |
| 424 | I | V | 0.515355817 | 0.185117148 |
| 907 | E | D | 0.514835248 | 0.277377403 |
| 923 | Q | E | 0.514826301 | 0.324456465 |
| 413 | W | L | 0.514728329 | 0.241932097 |
| 748 | Q | R | 0.514571576 | 0.240563892 |
| 591 | Q | H | 0.514415886 | 0.331792035 |
| 1 | Q | E | 0.514404075 | 0.263908964 |
| 171 | P | T | 0.513803013 | 0.237477165 |
| 544 | K | R | 0.512919851 | 0.163480182 |
| 677 | — | LSRFKD (SEQ ID NO: 3680) | 0.511837147 | 0.194279796 |
| 377 | L | M | 0.511718619 | 0.274965484 |
| 1 | Q | H | 0.511496323 | 0.29357307 |
| 202 | R | M | 0.511365875 | 0.303187834 |
| 422 | E | [stop] | 0.511043687 | 0.224103239 |
| 922 | E | [stop] | 0.510570886 | 0.450135707 |
| 407 | — | KKHGED (SEQ ID NO: 3681) | 0.510425363 | 0.211479415 |
| 8 | K | A | 0.510125467 | 0.417426274 |
| 300 | I | M | 0.510084254 | 0.178542003 |
| 668 | A | P | 0.509985424 | 0.202934866 |
| 917 | E | K | 0.509268127 | 0.386629094 |
| 12 | R | I | 0.509210198 | 0.267908359 |
| 326 | K | N | 0.508325806 | 0.277854988 |
| 802 | A | W | 0.507146644 | 0.398619961 |
| 627 | Q | H | 0.506946344 | 0.17779761 |
| 705 | Q | K | 0.506601342 | 0.205329495 |
| 935 | L | P | 0.505173269 | 0.279127846 |
| 636 | L | P | 0.504912592 | 0.279575261 |
| 378 | L | V | 0.504856105 | 0.146721248 |
| 770 | M | I | 0.502407214 | 0.148647414 |
| 302 | I | I | 0.502263164 | 0.328365742 |
| 584 | P | H | 0.501836401 | 0.188263444 |
| 962 | Q | H | 0.501557133 | 0.21210836 |
| 909 | F | L | 0.501216251 | 0.397907118 |
| 522 | G | C | 0.50035512 | 0.232143601 |
| 233 | M | I | 0.500272986 | 0.246898577 |
| 284 | P | R | 0.499965267 | 0.18413971 |
| 639 | E | D | 0.499845638 | 0.16815712 |
| 351 | K | E | 0.49917291 | 0.274793088 |
| 12 | R | S | 0.498984129 | 0.193129295 |
| 920 | A | V | 0.498509984 | 0.394258252 |
| 709 | E | [stop] | 0.498173203 | 0.222297538 |
| 443 | S | H | 0.498010803 | 0.445232627 |
| 27 | P | L | 0.497724007 | 0.373177387 |
| 849 | Q | K | 0.497661989 | 0.259123161 |
| 793 | — | Q | 0.497102388 | 0.47673495 |
| 750 | A | G | 0.496799617 | 0.243940432 |
| 26 | G | C | 0.496365725 | 0.228107532 |
| 706 | A | D | 0.494947511 | 0.225683587 |
| 431 | L | P | 0.494543065 | 0.192514906 |
| 13 | LV | AS | 0.494489513 | 0.367074627 |
| 0 | M | V | 0.49405414 | 0.206071479 |
| 614 | R | I | 0.494053835 | 0.209299062 |
| 248 | L | M | 0.49299868 | 0.24880607 |
| 81 | L | M | 0.492127571 | 0.369172142 |
| 418 | — | D | 0.49144742 | 0.21486801 |
| 914 | C | R | 0.490784001 | 0.353820866 |
| 3 | I | S | 0.490305334 | 0.219289736 |

TABLE 6-continued

| Fold enrichment of CasX DME Variants | | | | |
|---|---|---|---|---|
| Pos. | Ref. | Alt. | Med. Enrich. | 95% CI |
| 781 | W | L | 0.490256264 | 0.225567162 |
| 234 | G | [stop] | 0.489800943 | 0.231905474 |
| 369 | A | V | 0.489746571 | 0.142680124 |
| 685 | G | C | 0.48966455 | 0.174412352 |
| 498 | A | S | 0.489397172 | 0.173872708 |
| 746 | V | D | 0.488692506 | 0.484120982 |
| 666 | — | AG | 0.488446913 | 0.383322789 |
| 309 | W | L | 0.487964134 | 0.209151088 |
| 979 | — | VSSK (SEQ ID NO: 3669) | 0.486810051 | 0.287650542 |
| 27 | P | R | 0.486771244 | 0.185539954 |
| 583 | L | M | 0.486474099 | 0.232216764 |
| 760 | G | R | 0.485722591 | 0.195838563 |
| 596 | I | T | 0.485474246 | 0.130718203 |
| 189 | G | [stop] | 0.484957086 | 0.271997616 |
| 884 | W | L | 0.48469466 | 0.210361106 |
| 162 | E | [stop] | 0.484515492 | 0.270313618 |
| 405 | L | P | 0.484058533 | 0.143471721 |
| 815 | T | A | 0.483688268 | 0.140346764 |
| 875 | E | D | 0.483680843 | 0.230122106 |
| 703 | T | K | 0.483561705 | 0.243688021 |
| 35 | V | A | 0.48268809 | 0.163074127 |
| 320 | K | E | 0.482629615 | 0.202594011 |
| 203 | E | D | 0.48228135 | 0.173584261 |
| 202 | R | S | 0.482184999 | 0.1640178 |
| 613 | G | C | 0.482001189 | 0.220237462 |
| 220 | A | P | 0.481251117 | 0.159715468 |
| 920 | A | G | 0.481026982 | 0.321704418 |
| 874 | E | Q | 0.480905869 | 0.250463545 |
| 192 | A | G | 0.480770514 | 0.112319124 |
| 578 | P | T | 0.48002354 | 0.203348553 |
| 515 | A | P | 0.480000762 | 0.142980394 |
| 921 | D | Y | 0.479522102 | 0.330930172 |
| 17 | S | R | 0.479410291 | 0.242870401 |
| 23 | G | C | 0.47738757 | 0.286426817 |
| 892 | A | G | 0.477302415 | 0.253000116 |
| 832 | A | T | 0.47606534 | 0.23451824 |
| 421 | W | [stop] | 0.475666945 | 0.216973062 |
| 316 | R | S | 0.47464939 | 0.264534919 |
| 681 | K | N | 0.474468269 | 0.192816933 |
| 22 | A | V | 0.474221933 | 0.206217506 |
| 691 | L | M | 0.473867575 | 0.189071763 |
| 95 | L | V | 0.473859579 | 0.188485586 |
| 827 | K | N | 0.47365473 | 0.198868181 |
| 858 | R | M | 0.473407136 | 0.257236194 |
| 519 | Q | P | 0.472315609 | 0.224391717 |
| 95 | L | P | 0.471361064 | 0.162277972 |
| 976 | A | T | 0.470889659 | 0.109031 |
| 782 | L | I | 0.470558203 | 0.125178365 |
| 723 | A | S | 0.469929973 | 0.218713854 |
| 24 | K | R | 0.469399175 | 0.236250784 |
| 748 | Q | E | 0.46890075 | 0.291020418 |
| 686 | — | NPT | 0.468711675 | 0.157459195 |
| 1 | Q | L | 0.468380179 | 0.341181409 |
| 466 | G | V | 0.467982153 | 0.207162352 |
| 346 | — | MVC | 0.467747954 | 0.140593808 |
| 746 | V | L | 0.467699466 | 0.162488099 |
| 101 | Q | K | 0.467562845 | 0.263058522 |
| 99 | V | L | 0.467355555 | 0.098627209 |
| 354 | I | M | 0.46704321 | 0.243813968 |
| 826 | E | [stop] | 0.466802563 | 0.164892155 |
| 150 | P | L | 0.466773068 | 0.200507693 |
| 476 | C | R | 0.466682009 | 0.123054893 |
| 38 | P | H | 0.466309116 | 0.291701454 |
| 120 | E | [stop] | 0.465867266 | 0.21730484 |
| 370 | D | R | 0.465477814 | 0.252126933 |
| 7 | N | K | 0.465102103 | 0.221573061 |
| 55 | P | T | 0.465075846 | 0.236340763 |
| 681 | K | E | 0.464515385 | 0.142005053 |
| 781 | W | C | 0.464133122 | 0.295451154 |
| 946 | N | D | 0.463522655 | 0.373105851 |
| 368 | L | M | 0.463023353 | 0.266615533 |
| 0 | M | T | 0.462868938 | 0.232012879 |
| 737 | T | A | 0.462760296 | 0.301960654 |
| 847 | — | EGQI (SEQ ID NO: 3682) | 0.462759431 | 0.219565444 |

TABLE 6-continued

| Fold enrichment of CasX DME Variants | | | | |
|---|---|---|---|---|
| Pos. | Ref. | Alt. | Med. Enrich. | 95% CI |
| 0 | M | K | 0.462242932 | 0.245616902 |
| 711 | E | [stop] | 0.461879161 | 0.191719959 |
| 357 | K | N | 0.461332764 | 0.184353442 |
| 434 | H | D | 0.461154018 | 0.191223379 |
| 910 | V | E | 0.460870605 | 0.281013173 |
| 922 | E | D | 0.460080408 | 0.286351122 |
| 480 | L | D | 0.459795711 | 0.404684507 |
| 772 | E | G | 0.459510918 | 0.312503946 |
| 369 | A | P | 0.459368992 | 0.154954523 |
| 148 | G | C | 0.459321913 | 0.21989387 |
| 565 | E | [stop] | 0.459284191 | 0.257970072 |
| 472 | K | N | 0.458126194 | 0.217353923 |
| 19 | T | K | 0.458002489 | 0.250652905 |
| 550 | F | L | 0.457885561 | 0.135416611 |
| 612 | E | D | 0.457477443 | 0.18018994 |
| 761 | F | L | 0.457399802 | 0.126293846 |
| 104 | P | H | 0.457206235 | 0.205670388 |
| 588 | G | C | 0.457151433 | 0.254991865 |
| 516 | F | L | 0.456927783 | 0.127509134 |
| 147 | K | N | 0.456444496 | 0.280029247 |
| 651 | P | H | 0.456356549 | 0.186081926 |
| 2 | E | D | 0.456056175 | 0.35763481 |
| 643 | V | G | 0.455368156 | 0.295796806 |
| 524 | K | N | 0.45482233 | 0.143701874 |
| 18 | N | K | 0.454706199 | 0.199478283 |
| 5 | R | T | 0.45449471 | 0.277079709 |
| 920 | A | P | 0.45449471 | 0.288443793 |
| 701 | Q | H | 0.453812486 | 0.146230302 |
| 891 | E | [stop] | 0.453785945 | 0.233457013 |
| 133 | C | W | 0.453639333 | 0.137105208 |
| 370 | G | V | 0.453597184 | 0.202403506 |
| 548 | E | D | 0.453077345 | 0.109679349 |
| 689 | H | D | 0.453055551 | 0.09160837 |
| 931 | S | R | 0.45302365 | 0.382294772 |
| 133 | C | [stop] | 0.452586533 | 0.10138833 |
| 868 | E | [stop] | 0.452282618 | 0.301898798 |
| 33 | V | L | 0.451975838 | 0.159872004 |
| 266 | D | Y | 0.451699485 | 0.165335876 |
| 197 | E | D | 0.451539434 | 0.154482619 |
| 661 | E | [stop] | 0.45138977 | 0.234896635 |
| 897 | K | N | 0.451376493 | 0.172130787 |
| 894 | S | G | 0.451201568 | 0.216541569 |
| 46 | N | K | 0.450854268 | 0.293319843 |
| 42 | E | [stop] | 0.450047213 | 0.226279727 |
| 20 | K | N | 0.449773662 | 0.196721642 |
| 285 | H | N | 0.44861581 | 0.243329874 |
| 47 | L | V | 0.448153393 | 0.267732388 |
| 953 | D | E | 0.448187279 | 0.183598076 |
| 8 | K | E | 0.447865624 | 0.173510738 |
| 255 | K | N | 0.447654062 | 0.257753112 |
| 965 | Y | [stop] | 0.447638184 | 0.206848878 |
| 381 | L | V | 0.447518148 | 0.24623578 |
| 938 | Q | K | 0.44750144 | 0.297903846 |
| 719 | S | C | 0.4472033 | 0.232249869 |
| 89 | Q | K | 0.447094951 | 0.222907496 |
| 735 | R | L | 0.447058488 | 0.220193339 |
| 673 | E | G | 0.446968171 | 0.213951556 |
| 126 | G | C | 0.446802066 | 0.204738022 |
| 919 | H | D | 0.446668628 | 0.327432207 |
| 23 | G | V | 0.446595867 | 0.2102612 |
| 733 | M | I | 0.446594817 | 0.174646778 |
| 310 | Q | E | 0.446297431 | 0.123671296 |
| 729 | L | V | 0.445993097 | 0.433135394 |
| 455 | W | L | 0.445597501 | 0.281894997 |
| 215 | G | V | 0.445352945 | 0.205217458 |
| 135 | P | T | 0.44528202 | 0.217449002 |
| 936 | R | I | 0.445259832 | 0.32221387 |
| 519 | Q | K | 0.444720886 | 0.28933765 |
| 656 | G | R | 0.444552088 | 0.279063867 |
| 613 | G | R | 0.444378039 | 0.117584873 |
| 16 | D | Y | 0.44433236 | 0.241975919 |
| 5 | R | K | 0.443724261 | 0.262708705 |
| 3 | I | M | 0.443191661 | 0.128675121 |
| 523 | V | L | 0.443126307 | 0.088900743 |
| 760 | G | C | 0.442544743 | 0.174174731 |
| 27 | P | T | 0.442229152 | 0.271402709 |

TABLE 6-continued

Fold enrichment of CasX DME Variants

| Pos. | Ref. | Alt. | Med. Enrich. | 95% CI |
|---|---|---|---|---|
| 694 | G | D | 0.441607057 | 0.430247861 |
| 695 | E | D | 0.440698297 | 0.174763691 |
| 96 | M | I | 0.440309501 | 0.212758418 |
| 234 | G | V | 0.44028737 | 0.19450919 |
| 385 | E | D | 0.440128169 | 0.19408182 |
| 744 | Y | H | 0.439198298 | 0.25211241 |
| 519 | Q | H | 0.438343378 | 0.164581049 |
| 385 | E | [stop] | 0.438258279 | 0.212771705 |
| 793 | S | R | 0.438010456 | 0.160112082 |
| 726 | A | S | 0.437983799 | 0.129329735 |
| 953 | D | Y | 0.437888499 | 0.29124605 |
| 203 | E | [stop] | 0.437866757 | 0.193004717 |
| 887 | G | V | 0.437831028 | 0.150855683 |
| 189 | G | R | 0.437816981 | 0.195105194 |
| 672 | P | L | 0.437768207 | 0.1420574 |
| 906 | Q | R | 0.437668081 | 0.257388395 |
| 887 | G | R | 0.436446894 | 0.261046568 |
| 6 | I | T | 0.436255483 | 0.311769796 |
| 751 | M | R | 0.436212653 | 0.194544034 |
| 115 | V | A | 0.436134597 | 0.191229151 |
| 490 | R | G | 0.435740618 | 0.182925074 |
| 789 | E | G | 0.435579914 | 0.162786893 |
| 603 | — | LE | 0.43556049 | 0.202470667 |
| 442 | R | S | 0.435504028 | 0.210966357 |
| 714 | R | I | 0.435462316 | 0.200883142 |
| 8 | K | R | 0.435212211 | 0.195908908 |
| 854 | N | D | 0.43513717 | 0.067943636 |
| 335 | E | [stop] | 0.434927464 | 0.21407853 |
| 915 | G | R | 0.434895859 | 0.195491247 |
| 762 | G | C | 0.434868342 | 0.215911162 |
| 3 | I | T | 0.434607673 | 0.107252687 |
| 406 | E | [stop] | 0.434574625 | 0.271888642 |
| 710 | V | A | 0.434488312 | 0.161462791 |
| 594 | E | Q | 0.434478655 | 0.199232108 |
| 601 | L | M | 0.433295669 | 0.21298138 |
| 194 | — | DFY | 0.433205 | 0.315807396 |
| 79 | A | S | 0.433187114 | 0.14702693 |
| 913 | NC | FS | 0.432811714 | 0.214195068 |
| 955 | R | S | 0.432632415 | 0.15138175 |
| 793 | — | SKTYL (SEQ ID NO: 3683) | 0.432421193 | 0.207758327 |
| 171 | P | H | 0.432364213 | 0.194710101 |
| 560 | N | S | 0.432346515 | 0.239882019 |
| 370 | — | GYK | 0.432297106 | 0.219290605 |
| 321 | P | Q | 0.432271564 | 0.211438092 |
| 979 | LE[stop]GS-PG (SEQ ID NO: 3668) | VSSKDLRA (SEQ ID NO: 3684) | 0.432126183 | 0.250028634 |
| 21 | K | E | 0.431813708 | 0.20570077 |
| 348 | C | W | 0.431395847 | 0.285738532 |
| 712 | Q | E | 0.430794328 | 0.137430622 |
| 867 | V | A | 0.430546539 | 0.112438125 |
| 902 | H | N | 0.430482041 | 0.210989962 |
| 232 | C | R | 0.430431738 | 0.130635142 |
| 164 | E | [stop] | 0.43010378 | 0.307258004 |
| 348 | C | R | 0.429790014 | 0.254295816 |
| 13 | L | R | 0.429496589 | 0.209797858 |
| 11 | R | W | 0.429311947 | 0.298268587 |
| 944 | Q | E | 0.429084418 | 0.194128082 |
| 974 | K | E | 0.428778767 | 0.120819051 |
| 935 | L | M | 0.428357966 | 0..108223034 |
| 131 | Q | E | 0.427961752 | 0.108783149 |
| 961 | W | R | 0.427770336 | 0.153009954 |
| 508 | F | L | 0.427277307 | 0.150834085 |
| 732 | D | Y | 0.427260152 | 0.232782252 |
| 876 | S | G | 0.427219565 | 0.1654176 |
| 35 | M | I | 0.426965901 | 0.18021585 |
| 699 | E | [stop] | 0.426936027 | 0.247620152 |
| 624 | R | G | 0.426915666 | 0.161800086 |
| 687 | — | PTHIL (SEQ ID NO: 3685) | 0.426399688 | 0.235010897 |
| 176 | A | G | 0.425859136 | 0.154112817 |
| 256 | K | N | 0.425760398 | 0.195398586 |
| 904 | P | A | 0.425684716 | 0.273763449 |
| 859 | Q | K | 0.425619083 | 0.166409301 |
| 222 | G | [stop] | 0.425285813 | 0.299517445 |

TABLE 6-continued

Fold enrichment of CasX DME Variants

| Pos. | Ref. | Alt. | Med. Enrich. | 95% CI |
|---|---|---|---|---|
| 20 | K | E | 0.425128158 | 0.147645138 |
| 327 | G | C | 0.425002655 | 0.239317573 |
| 530 | L | P | 0.423859206 | 0.240275284 |
| 175 | E | Q | 0.423850119 | 0.242087732 |
| 797 | L | P | 0.423394833 | 0.254739368 |
| 351 | K | M | 0.423313443 | 0.177944606 |
| 912 | L | M | 0.423204978 | 0.27824291 |
| 188 | F | L | 0.422539663 | 0.187750751 |
| 850 | I | M | 0.422159968 | 0.218452121 |
| 391 | K | N | 0.422162984 | 0.158915852 |
| 894 | — | S | 0.42194087 | 0.23660887 |
| 758 | S | R | 0.420859106 | 0.119214586 |
| 941 | K | N | 0.420814047 | 0.266042931 |
| 381 | L | P | 0.42076192 | 0.122089029 |
| 926 | L | V | 0.42049552 | 0.169568285 |
| 873 | S | R | 0.420222785 | 0.189220359 |
| 823 | R | G | 0.420141589 | 0.140425724 |
| 703 | T | A | 0.419927183 | 0.299947391 |
| 265 | K | N | 0.419762272 | 0.205398427 |
| 904 | P | L | 0.419717349 | 0.24717221 |
| 315 | G | A | 0.419275038 | 0.167267502 |
| 346 | M | I | 0.418933456 | 0.153077303 |
| 301 | V | A | 0.418922077 | 0.253824177 |
| 545 | I | M | 0.418607437 | 0.264461321 |
| 676 | P | T | 0.41817469 | 0.167866208 |
| 516 | F | S | 0.418152987 | 0.18301751 |
| 790 | G | V | 0.417872524 | 0.178000118 |
| 890 | G | V | 0.417424955 | 0.242331279 |
| 684 | L | P | 0.41697175 | 0.237298169 |
| 369 | A | T | 0.416965887 | 0.158164268 |
| 890 | G | R | 0.416918523 | 0.30183511 |
| 515 | A | I | 0.416763488 | 0.158965629 |
| 903 | R | G | 0.416689964 | 0.149830948 |
| 898 | K | [stop] | 0.416641263 | 0.154852179 |
| 632 | L | V | 0.416523782 | 0.131108293 |
| 126 | G | D | 0.41639346 | 0.171080754 |
| 151 | H | R | 0.41621118 | 0.192083944 |
| 480 | L | P | 0.4153828 | 0.153349872 |
| 569 | M | I | 0.415261579 | 0.12705723 |
| 819 | A | S | 0.414776737 | 0.173259385 |
| 212 | E | [stop] | 0.414560972 | 0.214325617 |
| 104 | P | T | 0.414121539 | 0.241680787 |
| 765 | G | A | 0.413859942 | 0.202334164 |
| 862 | — | VK | 0.413059952 | 0.195129021 |
| 210 | P | A | 0.412638448 | 0.228860931 |
| 824 | V | A | 0.412207035 | 0.173953175 |
| 736 | N | K | 0.411883437 | 0.18103448 |
| 13 | L | H | 0.411795935 | 0.405614507 |
| 844 | L | V | 0.411372197 | 0.244473235 |
| 564 | G | C | 0.411344604 | 0.228201596 |
| 694 | G | R | 0.41123482 | 0.211796515 |
| 977 | V | L | 0.411157664 | 0.380351062 |
| 142 | E | K | 0.410509302 | 0.15102557 |
| 4 | K | E | 0.410380978 | 0.274892917 |
| 890 | G | D | 0.410337543 | 0.240602631 |
| 409 | H | D | 0.410132391 | 0.22531365 |
| 563 | S | C | 0.409998896 | 0.206123321 |
| 793 | S | N | 0.409457982 | 0.067541166 |
| 705 | Q | H | 0.409365382 | 0.15278139 |
| 515 | A | D | 0.409252018 | 0.206051204 |
| 382 | S | R | 0.408669778 | 0.157144259 |
| 97 | S | N | 0.408564877 | 0.109922347 |
| 624 | R | I | 0.40845718 | 0.228955853 |
| 568 | P | T | 0.408066084 | 0.284742394 |
| 702 | R | S | 0.408063786 | 0.129537189 |
| 796 | Y | N | 0.40788333 | 0.311628718 |
| 897 | K | R | 0.407876662 | 0.136002906 |
| 292 | A | V | 0.407642755 | 0.163883385 |
| 741 | L | Q | 0.407532982 | 0.11928093 |
| 315 | G | C | 0.407147181 | 0.218556644 |
| −1 | S | Y | 0.407080752 | 0.324937034 |
| 945 | T | I | 0.407011152 | 0.285905433 |
| 695 | E | [stop] | 0.406081569 | 0.227028835 |
| 956 | A | S | 0.405686952 | 0.185566124 |
| 752 | L | M | 0.405575007 | 0.172103348 |
| 45 | E | [stop] | 0.405531899 | 0.162357698 |

TABLE 6-continued

Fold enrichment of CasX DME Variants

| Pos. | Ref. | Alt. | Med. Enrich. | 95% CI |
|---|---|---|---|---|
| 487 | G | C | 0.405450681 | 0.290615306 |
| 310 | Q | R | 0.405123752 | 0.12048192 |
| 791 | L | P | 0.404916001 | 0.108993438 |
| 767 | R | I | 0.404746394 | 0.223610078 |
| 538 | G | C | 0.404409405 | 0.233295785 |
| 584 | P | A | 0.403953066 | 0.108926305 |
| 552 | A | D | 0.403929388 | 0.192995621 |
| 648 | N | D | 0.403814843 | 0.290734901 |
| 973 | W | L | 0.403521777 | 0.16358494 |
| 976 | A | S | 0.403444209 | 0.261893297 |
| 180 | L | P | 0.403389637 | 0.163854455 |
| 220 | A | S | 0.402957864 | 0.279961071 |
| 894 | — | SLLKK (SEQ ID NO: 3686) | 0.402797711 | 0.216370575 |
| 739 | R | I | 0.402772732 | 0.234602886 |
| 548 | E | [stop] | 0.402765683 | 0.262561545 |
| 764 | Q | K | 0.402617217 | 0.220740512 |
| 723 | A | D | 0.402461227 | 0.236080429 |
| 934 | F | L | 0.402458138 | 0.384373835 |
| 42 | E | D | 0.401939693 | 0.171540664 |
| 956 | A | G | 0.401859954 | 0.23877341 |
| 771 | A | D | 0.401428057 | 0.231350403 |
| 15 | K | M | 0.401237871 | 0.256454456 |
| 298 | A | V | 0.401000777 | 0.140487597 |
| 128 | A | P | 0.400992369 | 0.173078759 |
| 511 | Q | H | 0.400978135 | 0.171613013 |
| 26 | G | V | 0.400800405 | 0.212307845 |
| 591 | — | QGREFI (SEQ ID NO: 3687) | 0.400574847 | 0.190655853 |
| 156 | G | S | 0.400389686 | 0.306653761 |
| 728 | N | S | 0.400298817 | 0.177178828 |
| 917 | — | ETHADE (SEQ ID NO: 3688) | 0.400170477 | 0.15562198 |
| 640 | R | G | 0.399931978 | 0.200741 |
| 254 | I | M | 0.39981124 | 0.209846066 |
| 644 | L | P | 0.399481964 | 0.165702888 |
| 549 | A | S | 0.399416255 | 0.189530269 |
| 528 | L | V | 0.399354304 | 0.147818268 |
| 502 | I | V | 0.399285899 | 0.256373682 |
| 79 | A | D | 0.399080303 | 0.154917165 |
| 753 | I | M | 0.399024046 | 0.268887392 |
| 588 | G | D | 0.398941525 | 0.112261489 |
| 722 | Y | H | 0.398538883 | 0.164012123 |
| 550 | — | G | 0.398527591 | 0.353355602 |
| 133 | C | R | 0.398285042 | 0.283233819 |
| 591 | — | QG | 0.398079043 | 0.133460692 |
| 877 | V | L | 0.398057665 | 0.212468549 |
| 958 | V | A | 0.398007545 | 0.130004197 |
| 903 | R | I | 0.39789959 | 0.321002606 |
| 118 | G | D | 0.397657151 | 0.192339782 |
| 745 | A | S | 0.397594938 | 0.285476509 |
| 914 | C | F | 0.397278541 | 0.29475166 |
| 461 | — | SFV | 0.39704755 | 0.20205322 |
| 637 | — | TFE | 0.396824735 | 0.209304074 |
| 855 | R | M | 0.396780958 | 0.191874811 |
| 142 | E | [stop] | 0.396624103 | 0.229993954 |
| 108 | D | N | 0.396298431 | 0.15939576 |
| 730 | — | ADDMVRN (SEQ ID NO: 3689) | 0.395727458 | 0.207712648 |
| 241 | T | I | 0.395690613 | 0.131948289 |
| 641 | R | I | 0.395315387 | 0.202249461 |
| 364 | F | L | 0.395209211 | 0.112951976 |
| 739 | R | G | 0.395162717 | 0.191317885 |
| 446 | A | S | 0.39510798 | 0.254001902 |
| 593 | R | [stop] | 0.395071199 | 0.196636879 |
| 168 | L | P | 0.39502304 | 0.27101743 |
| 890 | G | C | 0.394653545 | 0.224530018 |
| 677 | — | LS | 0.394551417 | 0.187547463 |
| 47 | L | R | 0.394492318 | 0.238759289 |
| 339 | N | S | 0.394.482682 | 0.152047471 |
| 316 | R | G | 0.394439897 | 0.159274636 |
| 206 | H | N | 0.394299838 | 0.156799046 |
| 651 | P | A | 0.394024946 | 0.151434436 |
| 441 | R | G | 0.393551449 | 0.150649913 |
| 325 | L | P | 0.393343386 | 0.140601419 |
| 589 | K | N | 0.3926379 | 0.261890195 |

TABLE 6-continued

| Fold enrichment of CasX DME Variants | | | | |
|---|---|---|---|---|
| Pos. | Ref. | Alt. | Med. Enrich. | 95% CI |
| 873 | S | G | 0.392619693 | 0.143564629 |
| 414 | G | D | 0.392615344 | 0.149137614 |
| 237 | A | G | 0.392578525 | 0.167793454 |
| 479 | E | [stop] | 0.392365621 | 0.272905538 |
| 752 | L | V | 0.392234134 | 0.171880044 |
| 692 | R | I | 0.391963575 | 0.221910688 |
| 683 | S | Y | 0.39187962 | 0.197184801 |
| 568 | P | S | 0.391506615 | 0.094807068 |
| 114 | P | I | 0.391456539 | 0.163794182 |
| 341 | V | A | 0.391246425 | 0.087691935 |
| 50 | K | R | 0.39108021 | 0.159163965 |
| 698 | K | R | 0.390885992 | 0.181654156 |
| 979 | L- | V[stop] | 0.3907803 | 0.18994351 |
| 932 | W | G | 0.390757599 | 0.185057669 |
| 519 | Q | R | 0.390675235 | 0.117792262 |
| 140 | K | E | 0.390615529 | 0.123713502 |
| 40 | L | P | 0.390579865 | 0.194510846 |
| 978 | — | [stop] | 0.390537744 | 0.255501032 |
| 509 | S | T | 0.390466368 | 0.117704569 |
| 465 | E | [stop] | 0.390424913 | 0.211758729 |
| 88 | F | S | 0.390363974 | 0.156430305 |
| 429 | E | [stop] | 0.390336598 | 0.135919503 |
| 783 | — | TAK | 0.390178711 | 0.143499076 |
| 442 | R | M | 0.390097432 | 0.262199628 |
| 453 | T | A | 0.389911631 | 0.312187594 |
| 923 | Q | H | 0.389855175 | 0.353446475 |
| 666 | V | A | 0.389840585 | 0.169825945 |
| 499 | E | D | 0.38958943 | 0.172940321 |
| 930 | R | G | 0.389517964 | 0.2357312 |
| 847 | — | EGQITY (SEQ ID NO: 3690) | 0.389324278 | 0.122951036 |
| 846 | V | L | 0.389120343 | 0.259313474 |
| 908 | K | N | 0.38907418 | 0.225076472 |
| 975 | P | T | 0.388901662 | 0.256059318 |
| 149 | K | N | 0.38882454 | 0.171027465 |
| 691 | L | P | 0.388805401 | 0.14397393 |
| 207 | P | A | 0.387921412 | 0.102883658 |
| 11 | — | S | 0.387747808 | 0.379461072 |
| 638 | F | L | 0.387272475 | 0.168477543 |
| 558 | V | L | 0.386662896 | 0.254612529 |
| 816 | I | V | 0.386659025 | 0.185203822 |
| 680 | F | L | 0.386638685 | 0.211225716 |
| 329 | P | T | 0.386489681 | 0.220048383 |
| 576 | D | G | 0.386151413 | 0.113653327 |
| 225 | G | V | 0.386137184 | 0.239109613 |
| 22 | A | G | 0.385839168 | 0.336984972 |
| 146 | D | E | 0.385277721 | 0.095712474 |
| 507 | G | R | 0.385233777 | 0.212044164 |
| 523 | V | I | 0.385109283 | 0.152511446 |
| 501 | S | G | 0.385073546 | 0.140125388 |
| 763 | R | L | 0.38502172 | 0.191531655 |
| 705 | Q | E | 0.384851421 | 0.17568818 |
| 82 | H | D | 0.383907018 | 0.103874584 |
| 794 | K | N | 0.383803253 | 0.195192527 |
| 979 | LE[stop]GSPG (SEQ ID NO: 3668) | VSSKDLR (SEQ ID NO: 3691) | 0.38375861 | 0.240184851 |
| 894 | S | R | 0.383344078 | 0.273603195 |
| 639 | E | [stop] | 0.383174826 | 0.193125393 |
| 655 | I | M | 0.383102617 | 0.208514699 |
| 261 | L | V | 0.382856978 | 0.19611714 |
| 480 | L | R | 0.382841683 | 0.252187108 |
| 489 | L | V | 0.38262991 | 0.16124555 |
| 134 | Q | E | 0.382580711 | 0.180510987 |
| 650 | — | PA | 0.382487274 | 0.372015728 |
| 630 | P | H | 0.381699363 | 0.211396524 |
| 21 | K | R | 0.381603442 | 0.1634713 |
| 677 | — | LSR | 0.381372384 | 0.163400905 |
| 284 | P | T | 0.381276843 | 0.171865261 |
| 783 | T | R | 0.381262501 | 0.118770396 |
| 916 | F | V | 0.380756944 | 0.281228145 |
| 450 | A | T | 0.38074186 | 0.136570467 |
| 906 | Q | E | 0.380700478 | 0.285392821 |
| 29 | K | [stop] | 0.380574061 | 0.171976662 |
| 936 | R | I | 0.38042421 | 0.204558309 |
| 754 | F | I | 0.380277272 | 0.145574058 |

TABLE 6-continued

Fold enrichment of CasX DME Variants

| Pos. | Ref. | Alt. | Med. Enrich. | 95% CI |
|---|---|---|---|---|
| 315 | G | S | 0.380117687 | 0.143338421 |
| 89 | Q | [stop] | 0.379768129 | 0.102222221 |
| 289 | G | C | 0.379664161 | 0.235845043 |
| 750 | A | T | 0.379378398 | 0.182932261 |
| 216 | G | C | 0.379274317 | 0.176888646 |
| 303 | W | C | 0.379215164 | 0.182222922 |
| 295 | N | K | 0.379144284 | 0.378487654 |
| 919 | H | Y | 0.379137691 | 0.321018649 |
| 726 | A | D | 0.379067543 | 0.145080733 |
| 133 | C | S | 0.378841599 | 0.162936296 |
| 497 | E | [stop] | 0.378292682 | 0.202801468 |
| 444 | E | K | 0.378042967 | 0.318660643 |
| 693 | I | M | 0.378036899 | 0.225823359 |
| 587 | F | L | 0.377947216 | 0.117981043 |
| 291 | E | D | 0.377733323 | 0.142365006 |
| 85 | W | S | 0.377648166 | 0.097279693 |
| 165 | R | M | 0.377647305 | 0.161201002 |
| 569 | M | I | 0.377387614 | 0.195898876 |
| 247 | I | I | 0.37729282 | 0.165305688 |
| 513 | — | N | 0.377106209 | 0.14731404 |
| 754 | F | L | 0.376911731 | 0.164266559 |
| 21 | K | [stop] | 0.376868031 | 0.199468055 |
| 268 | A | T | 0.376839819 | 0.129211081 |
| 672 | P | T | 0.376830532 | 0.204970386 |
| 735 | R | [stop] | 0.376814295 | 0.09621637 |
| 147 | K | E | 0.376789616 | 0.140417542 |
| 904 | P | R | 0.37666328 | 0.185106225 |
| 712 | Q | H | 0.376030218 | 0.227827888 |
| 2 | E | V | 0.375325693 | 0.197955097 |
| 184 | S | I | 0.375300851 | 0.252137747 |
| 163 | H | D | 0.3751698 | 0.208290707 |
| 677 | L | P | 0.375131489 | 0.090158552 |
| 44 | L | P | 0.374906966 | 0.249472829 |
| 606 | G | V | 0.374739683 | 0.285964981 |
| 937 | S | G | 0.374669762 | 0.248499289 |
| 727 | K | N | 0.374273348 | 0.164838535 |
| 734 | D | A | 0.374244799 | 0.121134147 |
| 902 | H | Q | 0.374087073 | 0.175219897 |
| 398 | F | L | 0.373909011 | 0.239653674 |
| 845 | K | N | 0.373742099 | 0.158752661 |
| 822 | D | N | 0.373424135 | 0.138952336 |
| 136 | L | M | 0.372880562 | 0.202180857 |
| 543 | K | E | 0.372880222 | 0.146877967 |
| 244 | Q | H | 0.372873077 | 0.184616643 |
| 403 | L | R | 0.372697479 | 0.330913239 |
| 679 | R | I | 0.372176403 | 0.370324076 |
| 738 | A | D | 0.372074442 | 0.291834989 |
| 155 | F | L | 0.371845015 | 0.114679195 |
| 174 | P | R | 0.371603352 | 0.137168151 |
| 919 | H | N | 0.371556993 | 0.327290993 |
| 944 | Q | H | 0.37144256 | 0.338788753 |
| 164 | E | G | 0.370935537 | 0.216755032 |
| 197 | S | G | 0.370856052 | 0.178568608 |
| 840 | N | K | 0.370814634 | 0.142530771 |
| 13 | L | M | 0.370495333 | 0.29166367 |
| 488 | D | N | 0.370055302 | 0.226946737 |
| 929 | A | P | 0.370027168 | 0.168555798 |
| 580 | L | V | 0.36995513 | 0.139984948 |
| 135 | P | A | 0.369933138 | 0.10604161 |
| 342 | D | Y | 0.369924443 | 0.189241086 |
| 959 | ET | AV | 0.369879201 | 0.114167508 |
| 557 | T | A | 0.369640872 | 0.087836911 |
| 6 | I | V | 0.369460173 | 0.192497769 |
| 92 | P | T | 0.368981275 | 0.236532466 |
| 292 | A | T | 0.36879806 | 0.193425471 |
| 465 | E | D | 0.36752489 | 0.224455423 |
| 189 | — | GQRALDFY (SEQ ID NO: 3692) | 0.368745456 | 0.227136846 |
| 805 | T | A | 0.368671629 | 0.11272788 |
| 947 | K | E | 0.368551642 | 0.227968732 |
| 148 | G | D | 0.36788165 | 0.139635081 |
| 129 | C | W | 0.367758112 | 0.199915902 |
| 129 | C | [stop] | 0.367708546 | 0.192643557 |
| 98 | R | T | 0.367673403 | 0.174398036 |
| 478 | C | W | 0.367598979 | 0.111931907 |
| 228 | L | M | 0.367328433 | 0.24869867 |

TABLE 6-continued

Fold enrichment of CasX DME Variants

| Pos. | Ref. | Alt. | Med. Enrich. | 95% CI |
|---|---|---|---|---|
| 547 | P | H | 0.367324308 | 0.220855574 |
| 105 | K | N | 0.367245695 | 0.155463083 |
| 597 | W | R | 0.367058721 | 0.142955163 |
| 328 | F | L | 0.366955458 | 0.100787228 |
| 469 | E | [stop] | 0.366917206 | 0.180496612 |
| 130 | S | T | 0.366622403 | 0.127263853 |
| 283 | Q | E | 0.366530641 | 0.247989672 |
| 958 | V | L | 0.366470474 | 0.270699212 |
| 673 | E | Q | 0.366346139 | 0.219545941 |
| 118 | G | C | 0.366255984 | 0.265748809 |
| 848 | G | V | 0.366195099 | 0.200861106 |
| 923 | G | L | 0.366184575 | 0.233234243 |
| 357 | K | R | 0.366148171 | 0.185792239 |
| 623 | — | RRTRQD (SEQ ID | 0.365486053 | 0.26101804 |
| 85 | W | C | 0.365346783 | 0.146084706 |
| 376 | — | ALLPY (SEQ ID NO: 3694) | 0.365321474 | 0.191317647 |
| 356 | E | D | 0.365050343 | 0.136074432 |
| 262 | A | S | 0.365012551 | 0.204615446 |
| 765 | G | S | 0.3649426 | 0.100657536 |
| 717 | — | GYSR (SEQ ID NO: 3695) | 0.364903794 | 0.186125273 |
| 199 | H | V | 0.364586783 | 0.168211628 |
| 796 | Y | H | 0.364521403 | 0.145575579 |
| 237 | A | P | 0.364453395 | 0.150681341 |
| 768 | T | A | 0.36435574 | 0.18512185 |
| 513 | N | D | 0.364305814 | 0.16260499 |
| 823 | RV | LS | 0.364237044 | 0.11377221 |
| 656 | G | A | 0.364010939 | 0.135958583 |
| 276 | P | I | 0.363878534 | 0.201304545 |
| 214 | I | V | 0.363876419 | 0.142178855 |
| 300 | I | V | 0.363823907 | 0.234997169 |
| 769 | F | S | 0.363687361 | 0.079831237 |
| 182 | T | R | 0.363686071 | 0.201742372 |
| 677 | L | V | 0.363578004 | 0.138045802 |
| 796 | Y | C | 0.363566923 | 0.281557418 |
| 5 | R | S | 0.363258223 | 0.211185531 |
| 298 | A | S | 0.36320777 | 0.211187305 |
| 594 | E | [stop] | 0.36278807 | 0.205352129 |
| 105 | K | R | 0.362205009 | 0.140104618 |
| 907 | E | Q | 0.362024887 | 0.226228418 |
| 509 | S | G | 0.361807445 | 0.13953396 |
| 110 | R | I | 0.361752083 | 0.138681372 |
| 406 | E | Q | 0.361750488 | 0.303638253 |
| 470 | A | V | 0.361349462 | 0.10686226 |
| 4 | K | [stop] | 0.36129388 | 0.179352157 |
| 362 | K | E | 0.361196668 | 0.232368389 |
| 713 | R | G | 0.3607467 | 0.181817788 |
| 857 | K | N | 0.360715256 | 0.172046815 |
| 120 | E | D | 0.36030686 | 0.214810208 |
| 277 | K | E | 0.36002957 | 0.210892547 |
| 477 | RCELK (SEQ ID NO: 3698) | SFSSH (SEQ ID NO: 3699) | 0.360015336 | 0.177473578 |
| 532 | I | T | 0.359759307 | 0.145072322 |
| 774 | Q | K | 0.359747336 | 0.182131652 |
| 439 | E | D | 0.359587685 | 0.134619305 |
| 198 | I | T | 0.359370526 | 0.173615874 |
| 156 | G | C | 0.359055571 | 0.173590319 |
| 399 | G | C | 0.358922413 | 0.255017848 |
| 59 | S | I | 0.358703019 | 0.109042363 |
| 93 | V | M | 0.358615623 | 0.161948363 |
| 674 | G | [stop] | 0.358503233 | 0.220631194 |
| 539 | K | N | 0.358074633 | 0.087009621 |
| 709 | E | D | 0.357944736 | 0.136689683 |
| 120 | E | G | 0.357933511 | 0.168382586 |
| 494 | F | L | 0.357874746 | 0.139367085 |
| 272 | G | V | 0.357428523 | 0.207170798 |
| 527 | N | I | 0.357320226 | 0.086164887 |
| 236 | V | A | 0.357249373 | 0.125737046 |
| 974 | K | N | 0.357242055 | 0.190403244 |
| 10 | RR | PG | 0.356712463 | 0.324298272 |
| 39 | D | Y | 0.356585187 | 0.235756832 |
| 579 | N | S | 0.3558347 | 0.181516226 |
| 214 | I | M | 0.355779849 | 0.142887254 |
| 843 | E | [stop] | 0.355689249 | 0.225441771 |

TABLE 6-continued

Fold enrichment of CasX DME Variants

| Pos. | Ref. | Alt. | Med. Enrich. | 95% CI |
|---|---|---|---|---|
| 526 | — | LNLY (SEQ ID NO: 3700) | 0.355597159 | 0.179351732 |
| 667 | I | M | 0.355548811 | 0.239632986 |
| 559 | I | V | 0.355478406 | 0.171281999 |
| 706 | A | S | 0.355431605 | 0.116949175 |
| 11 | RR | TS | 0.35536352 | 0.272262643 |
| 865 | L | Q | 0.355287262 | 0.164676142 |
| 946 | N | K | 0.355277474 | 0.180093688 |
| 689 | HI | PV | 0.355052108 | 0.144577201 |
| 898 | K | N | 0.354894826 | 0.200062158 |
| 950 | — | GN | 0.354845909 | 0.167057981 |
| 332 | P | T | 0.354796362 | 0.20270742 |
| 323 | Q | E | 0.354759964 | 0.249399571 |
| 42 | E | A | 0.354721226 | 0.213005644 |
| 22 | A | T | 0.354629728 | 0.083320918 |
| 948 | T | S | 0.354488334 | 0.198422577 |
| 16 | D | E | 0.354450775 | 0.187189495 |
| 170 | S | Y | 0.354344814 | 0.160709939 |
| 862 | — | VKDLS (SEQ ID NO: 3701) | 0.354059938 | 0.179170942 |
| 249 | E | [stop] | 0.354016591 | 0.294486267 |
| 531 | I | M | 0.353941253 | 0.095481374 |
| 266 | D | H | 0.35392753 | 0.237329699 |
| 859 | Q | E | 0.353923377 | 0.126451964 |
| 113 | I | V | 0.353631334 | 0.187941798 |
| 136 | L | P | 0.353572714 | 0.240617705 |
| 503 | L | M | 0.353400839 | 0.174768283 |
| 51 | P | R | 0.353321532 | 0.126698252 |
| 179 | E | D | 0.353270131 | 0.108592116 |
| 31 | L | V | 0.353260601 | 0.168619621 |
| 502 | I | F | 0.353258477 | 0.139633145 |
| 378 | L | M | 0.353221613 | 0.189998728 |
| 890 | G | A | 0.353138339 | 0.149947604 |
| 913 | N | K | 0.353092797 | 0.294888192 |
| 956 | A | D | 0.352997131 | 0.204713576 |
| 158 | C | W | 0.352758393 | 0.130405614 |
| 157 | — | RCNV (SEQ ID NO: 3702) | 0.352566351 | 0.116984328 |
| 771 | A | G | 0.352390901 | 0.141133059 |
| 227 | A | G | 0.352335693 | 0.141777326 |
| 202 | RE | G- | 0.352321171 | 0.210660545 |
| 99 | V | F | 0.352314021 | 0.162936095 |
| 643 | V | E | 0.352268894 | 0.209333581 |
| 41 | R | I | 0.352205261 | 0.321737078 |
| 387 | R | P | 0.352184692 | 0.159814147 |
| 539 | K | E | 0.351957196 | 0.146275596 |
| 478 | C | F | 0.351788403 | 0.313141443 |
| 942 | K | E | 0.351775756 | 0.256493816 |
| 36 | M | I | 0.351715805 | 0.097577134 |
| 644 | L | V | 0.351676716 | 0.163471035 |
| 78 | K | E | 0.35167205 | 0.128519193 |
| 272 | G | C | 0.351365895 | 0.208785029 |
| 157 | — | RCNVSEHE (SEQ ID NO: 3703) | 0.351115058 | 0.126463217 |
| 883 | S | R | 0.351093302 | 0.143213807 |
| 917 | E | V | 0.350763439 | 0.206641731 |
| 843 | E | 0 | 0.350569244 | 0.142523946 |
| 870 | D | Y | 0.350431061 | 0.194706521 |
| 393 | F | V | 0.35027948 | 0.168738586 |
| 162 | E | K | 0.350236681 | 0.12523983 |
| 119 | N | D | 0.350147467 | 0.235898677 |
| 306 | L | M | 0.349889759 | 0.165537841 |
| 110 | R | T | 0.349523294 | 0.289863999 |
| 976 | A | D | 0.34941868 | 0.2410.42383 |
| 914 | C | W | 0.349231308 | 0.169568161 |
| 115 | V | M | 0.349160578 | 0.17839763 |
| 863 | K | N | 0.348978081 | 0.175915912 |
| 830 | K | R | 0.348789882 | 0.11782242 |
| 564 | G | S | 0.348654331 | 0.240781896 |
| 647 | S | I | 0.348570495 | 0.163208612 |
| 617 | E | D | 0.348384104 | 0.103608149 |
| 262 | A | T | 0.348231917 | 0.222328473 |
| 713 | R | I | 0.348163293 | 0.202182526 |
| 893 | L | P | 0.348133135 | 0.24849422 |
| 202 | R | G | 0.347997162 | 0.177282082 |
| 806 | S | Y | 0.347673828 | 0.200543155 |

TABLE 6-continued

| Fold enrichment of CasX DME Variants | | | | |
|---|---|---|---|---|
| Pos. | Ref. | Alt. | Med. Enrich. | 95% CI |
| 391 | K | R | 0.347608788 | 0.122435715 |
| 683 | S | C | 0.34755615 | 0.102168244 |
| 446 | A | I | 0.347296208 | 0.236243043 |
| 282 | P | A | 0.347073665 | 0.253113968 |
| 580 | L | P | 0.347062657 | 0.078573865 |
| 895 | L | P | 0.347059979 | 0.152424473 |
| 929 | A | I | 0.34702013 | 0.306789031 |
| 108 | D | Y | 0.347014656 | 0.291577591 |
| 258 | E | [stop] | 0.34694757 | 0.281979872 |
| 673 | E | A | 0.346691172 | 0.265253287 |
| 950 | G | D | 0.346646349 | 0.128298199 |
| 792 | P | T | 0.346487957 | 0.236073016 |
| 673 | E | [stop] | 0.346388527 | 0.198074161 |
| 150 | P | R | 0.34632855 | 0.278480507 |
| 456 | L | P | 0.345951509 | 0.161500864 |
| 790 | G | R | 0.345911786 | 0.179210019 |
| 647 | S | T | 0.345819661 | 0.158521168 |
| 542 | F | S | 0.3.45619595 | 0.191970857 |
| 841 | G | D | 0.345447865 | 0.129392183 |
| 57 | P | A | 0.345371652 | 0.147875225 |
| 578 | P | R | 0.345346371 | 0.12075926 |
| 793 | S | I | 0.3.45235059 | 0.262377638 |
| 453 | T | S | 0.345118763 | 0.097101409 |
| 651 | P | R | 0.345088622 | 0.208316961 |
| 556 | Y | [stop] | 0.345070339 | 0.114662396 |
| 86 | E | [stop] | 0.3.44943839 | 0.21976554 |
| 646 | S | G | 0.344888595 | 0.154435246 |
| 592 | G | C | 0.34478874 | 0.240350052 |
| 49 | K | N | 0.344659946 | 0.130706516 |
| 586 | A | D | 0.344294219 | 0.15117877 |
| 166 | L | V | 0.34415435 | 0.139737754 |
| 726 | A | P | 0.344144415 | 0.164178243 |
| 666 | V | L | 0.344130904 | 0.155760915 |
| 749 | D | H | 0.344052929 | 0.242192495 |
| 486 | Y | C | 0.34395063 | 0.130965705 |
| 134 | Q | K | 0.343594633 | 0.210709609 |
| 91 | D | H | 0.34352508 | 0.153686099 |
| 40 | LR | PV | 0.343506493 | 0.155292328 |
| 12 | R | T | 0.343490891 | 0.187270573 |
| 653 | N | D | 0.343487264 | 0.148663517 |
| 52 | E | Q | 0.343438912 | 0.247941408 |
| 8 | K | Q | 0.343298615 | 0.279455517 |
| 555 | R | L | 0.343270194 | 0.098281937 |
| 294 | N | D | 0.343264324 | 0.126839815 |
| 553 | N | D | 0.342736197 | 0.153294035 |
| 893 | L | M | 0.342736077 | 0.179172833 |
| 951 | N | K | 0.342592943 | 0.278844401 |
| 51 | P | T | 0.342576973 | 0.1929364 |
| 649 | I | T | 0.342534817 | 0.270208479 |
| 175 | E | D | 0.342455704 | 0.202360388 |
| 823 | R | S | 0.341965728 | 0.273152096 |
| 219 | C | R | 0.341954249 | 0.136482174 |
| 283 | Q | R | 0.341949927 | 0.224313066 |
| 444 | E | [stop] | 0.341881438 | 0.217688103 |
| 649 | I | V | 0.341655494 | 0.148589673 |
| 854 | N | K | 0.341614877 | 0.1579.48422 |
| 514 | C | S | 0.34160113 | 0.231141571 |
| 623 | — | RRTR (SEQ ID NO: 3704) | 0.341527608 | 0.187073234 |
| 585 | L | M | 0.341496703 | 0.21431877 |
| 211 | — | LE | 0.341207432 | 0.169230112 |
| 544 | K | E | 0.341142267 | 0.208342511 |
| 478 | C | R | 0.341091687 | 0.148433288 |
| 858 | R | G | 0.340977066 | 0.206052559 |
| 172 | H | D | 0.340873936 | 0.298188428 |
| 16 | D | A | 0.340771918 | 0.308121625 |
| 525 | K | N | 0.340626838 | 0.147516442 |
| 532 | I | V | 0.340576058 | 0.099088927 |
| 520 | K | [stop] | 0.34056167 | 0.228510512 |
| 743 | Y | [stop] | 0.340397436 | 0.102396798 |
| 344 | W | C | 0.340364668 | 0.176812201 |
| 220 | A | G | 0.340276978 | 0.133945921 |
| 186 | G | V | 0.340265085 | 0.116877863 |
| 694 | G | C | 0.340225482 | 0.309935909 |
| 411 | E | Q | 0.340144727 | 0.282548314 |
| 406 | E | G | 0.340120492 | 0.140875629 |

TABLE 6-continued

Fold enrichment of CasX DME Variants

| Pos. | Ref. | Alt. | Med. Enrich. | 95% CI |
|---|---|---|---|---|
| 573 | F | L | 0.340030507 | 0.166015227 |
| 458 | A | G | 0.339794018 | 0.171435317 |
| 675 | C | [stop] | 0.339687357 | 0.208292109 |
| 576 | D | Y | 0.339621402 | 0.21774439 |
| 787 | A | S | 0.339526186 | 0.318305548 |
| 537 | G | C | 0.339454064 | 0.174110887 |
| 185 | — | LG | 0.339451721 | 0.186103153 |
| 844 | L | P | 0.339318044 | 0.191881119 |
| 712 | Q | K | 0.339288003 | 0.193891353 |
| 591 | Q | R | 0.339223049 | 0.160616368 |
| 169 | L | P | 0.339210958 | 0.127439702 |
| 923 | — | QAALN (SEQ ID NO: 3705) | 0.339143383 | 0.169170821 |
| 623 | R | S | 0.339131953 | 0.245088648 |
| 589 | K | Q | 0.33901987 | 0.177422866 |
| 522 | G | V | 0.338985606 | 0.226282565 |
| 204 | S | T | 0.338673547 | 0.170845305 |
| 698 | K | E | 0.338580473 | 0.129708045 |
| 497 | E | V | 0.338306724 | 0.13489235 |
| 23 | G | S | 0.338162596 | 0.15304761 |
| 29 | K | R | 0.337989172 | 0.147861886 |
| 716 | G | V | 0.337974681 | 0.202399788 |
| 703 | T | S | 0.337889214 | 0.141977828 |
| 979 | LE[stop]GSPG (SEQ ID NO: 3668) | VSSKDLE (SEQ ID NO: 3706) | 0.337814175 | 0.168342402 |
| 240 | L | M | 0.3377179 | 0.151631422 |
| 950 | G | C | 0.337265205 | 0.234973706 |
| 7 | N | S | 0.337036852 | 0.185037778 |
| 64 | A | P | 0.336967696 | 0.255179815 |
| 795 | T | S | 0.336837648 | 0.117371137 |
| 480 | L | Q | 0.336803159 | 0.213915334 |
| 600 | L | V | 0.336801383 | 0.230766925 |
| 175 | E | [stop] | 0.336712437 | 0.187755487 |
| 63 | R | S | 0.336640982 | 0.183725757 |
| 394 | A | P | 0.336388779 | 0.125201204 |
| 52 | E | [stop] | 0.336207682 | 0.211986135 |
| 299 | Q | E | 0.336024324 | 0.156699489 |
| 183 | YS | WM | 0.335855997 | 0.179538112 |
| 194 | D | Y | 0.335755348 | 0.131644969 |
| 213 | Q | R | 0.335726769 | 0.209853061 |
| 802 | A | D | 0.33571172 | 0.168573673 |
| 163 | H | N | 0.33571123 | 0.197315666 |
| 943 | Y | C | 0.335604909 | 0.172843558 |
| 118 | G | S | 0.3355.14316 | 0.125891126 |
| 758 | S | G | 0.335513561 | 0.149050456 |
| 941 | K | [stop] | 0.335374859 | 0.192348189 |
| 279 | — | TLPPQPH (SEQ ID NO: 3707) | 0.335305655 | 0.144688363 |
| 632 | LF | PV | 0.335263893 | 0.113883053 |
| 894 | — | SLLKKR (SEQ ID NO: 3708) | 0.335263893 | 0.141289109 |
| 943 | V | [stop] | 0.335115123 | 0.291608146 |
| 38 | P | R | 0.33481965 | 0.113021039 |
| 616 | I | F | 0.334790976 | 0.107803908 |
| 134 | Q | H | 0.334549336 | 0.158461695 |
| 186 | G | C | 0.334321874 | 0.156717674 |
| 184 | S | G | 0.334296555 | 0.223929833 |
| 765 | G | C | 0.33423513 | 0.213904011 |
| 687 | P | T | 0.334191461 | 0.22545553 |
| 803 | — | QYT | 0.33418367 | 0.096860089 |
| 374 | Q | R | 0.334175524 | 0.104826318 |
| 455 | W | C | 0.334165051 | 0.186741008 |
| 552 | — | ANRFY (SEQ ID NO: 3709) | 0.333923423 | 0.2586.49392 |
| 407 | K | R | 0.333913165 | 0.142719617 |
| 175 | E | K | 0.333834455 | 0.196225639 |
| 610 | — | LANGR (SEQ ID NO: 3710) | 0.333428825 | 0.102899397 |
| 230 | — | DACM (SEQ ID NO: 3711) | 0.333428825 | 0.108521075 |
| 848 | G | S | 0.333406808 | 0.165245749 |
| 630 | P | R | 0.333389309 | 0.182782946 |
| 442 | R | G | 0.333281333 | 0.186150848 |
| 836 | M | T | 0.33320739 | 0.215623837 |
| 222 | G | V | 0.333139545 | 0.173506426 |

TABLE 6-continued

Fold enrichment of CasX DME Variants

| Pos. | Ref. | Alt. | Med. Enrich. | 95% CI |
|---|---|---|---|---|
| 21 | K | I | 0.333022379 | 0.190202016 |
| 696 | S | I | 0.332955668 | 0.138037632 |
| 635 | A | T | 0.332902532 | 0.130552446 |
| 551 | E | G | 0.332833114 | 0.158314375 |
| 780 | D | Y | 0.332787267 | 0.203141483 |
| 47 | L | M | 0.332771785 | 0.228474741 |
| 347 | V | L | 0.332766547 | 0.164853137 |
| 841 | G | C | 0.332584425 | 0.2483922 |
| 593 | R | I | 0.332546881 | 0.22140312 |
| 749 | D | Y | 0.332359902 | 0.199451757 |
| 27 | P | S | 0.332358372 | 0.306966339 |
| 276 | P | H | 0.332221583 | 0.26420075 |
| 293 | Y | [stop] | 0.332046234 | 0.133526657 |
| 3 | I | N | 0.332004357 | 0.072687293 |
| 642 | — | EVLD (SEQ ID NO: 3712) | 0.331972419 | 0.22538863 |
| 620 | L | P | 0.331807594 | 0.15763111 |
| 456 | L | V | 0.331754102 | 0.143226803 |
| 130 | S | G | 0.331571239 | 0.167684126 |
| 629 | E | K | 0.33154282 | 0.153428302 |
| 950 | G | V | 0.331464709 | 0.229681218 |
| 328 | F | Y | 0.331454046 | 0.090600532 |
| 303 | W | S | 0.331070804 | 0.245928403 |
| 421 | W | C | 0.330779828 | 0.216037825 |
| 351 | K | R | 0.330630005 | 0.142537112 |
| 498 | A | T | 0.33049042 | 0.166213318 |
| 937 | S | I | 0.330380882 | 0.231058955 |
| 592 | GR | DN | 0.329593548 | 0.300041765 |
| 127 | F | I | 0.329561201 | 0.268089932 |
| 837 | T | S | 0.329510402 | 0.099725089 |
| 704 | I | I | 0.329114566 | 0.113551049 |
| 387 | R | L | 0.328928103 | 0.199189713 |
| 171 | P | R | 0.328685191 | 0.279786527 |
| 767 | R | T | 0.328611454 | 0.173820273 |
| 597 | W | L | 0.328585458 | 0.282536549 |
| 955 | R | G | 0.328533511 | 0.252801289 |
| 629 | E | [stop] | 0.328472442 | 0.226070443 |
| 699 | E | G | 0.328340286 | 0.161755276 |
| 564 | G | A | 0.328244232 | 0.11512512 |
| 129 | C | F | 0.327975914 | 0.184885596 |
| 26 | D | S | 0.327861024 | 0.174859434 |
| 199 | H | N | 0.327823226 | 0.25147122 |
| 701 | Q | R | 0.327746296 | 0.151982714 |
| 186 | G | D | 0.327613843 | 0.101552272 |
| 422 | E | D | 0.327579534 | 0.227939955 |
| 924 | A | T | 0.327501843 | 0.29494568 |
| 176 | A | P | 0.32741005 | 0.239900376 |
| 499 | E | K | 0.327284744 | 0.159757942 |
| 546 | K | R | 0.327156617 | 0.166513946 |
| 556 | Y | H | 0.327151432 | 0.118520339 |
| 548 | — | EAF | 0.326965289 | 0.171181066 |
| 901 | S | I | 0.326880206 | 0.3201.48616 |
| 14 | V | I | 0.326870011 | 0.276842054 |
| 814 | F | L | 0.32685269 | 0.084563864 |
| 157 | — | RCNVSE (SEQ ID NO: 3713) | 0.326801479 | 0.200654893 |
| 250 | H | R | 0.326584294 | 0.078102923 |
| 730 | A | V | 0.326443401 | 0.110931779 |
| 497 | E | Q | 0.326193187 | 0.212891542 |
| 536 | K | R | 0.326129704 | 0.20597101 |
| 906 | Q | P | 0.326073598 | 0.193779388 |
| 243 | Y | D | 0.326001836 | 0.130392708 |
| 798 | S | F | 0.325769587 | 0.320454172 |
| 882 | S | G | 0.325732755 | 0.141569252 |
| 759 | R | G | 0.325319087 | 0.080028833 |
| 576 | D | V | 0.325192282 | 0.239519469 |
| 309 | W | [stop] | 0.325098891 | 0.096106342 |
| 554 | R | I | 0.325075441 | 0.185726803 |
| 483 | Q | H | 0.324598695 | 0.153049426 |
| 979 | -E | VSSKDQ (SEQ ID NO: 3714) | 0.324398559 | 0.118712651 |
| 834 | G | C | 0.324348652 | 0.175539945 |
| 719 | S | Y | 0.324298439 | 0.22105488 |
| 842 | K | R | 0.324267597 | 0.102772814 |
| 97 | S | T | 0.324252325 | 0.240123255 |
| 172 | H | N | 0.32.4047776 | 0.168532939 |

TABLE 6-continued

| Fold enrichment of CasX DME Variants | | | | |
|---|---|---|---|---|
| Pos. | Ref. | Alt. | Med. Enrich. | 95% CI |
| 692 | R | G | 0.324024313 | 0.134914995 |
| 39 | D | V | 0.324012084 | 0.186802864 |
| 776 | T | I | 0.323918216 | 0.153171775 |
| 652 | M | I | 0.323898442 | 0.13705991 |
| 611 | A | V | 0.323836429 | 0.18975125 |
| 658 | D | G | 0.323834837 | 0.116577804 |
| 158 | C | [stop] | 0.323773158 | 0.093674966 |
| 887 | G | A | 0.32369757 | 0.19151617 |
| 337 | Q | H | 0.323607141 | 0.165283008 |
| 319 | A | D | 0.323458799 | 0.152084781 |
| 215 | — | GGNSCA (SEQ ID NO: 3715) | 0.323334457 | 0.165215546 |
| 351 | K | N | 0.323273003 | 0.138737748 |
| 878 | — | I | 0.323133111 | 0.265099492 |
| 597 | W | C | 0.323039345 | 0.210227048 |
| 85 | W | G | 0.3230112 | 0.140970302 |
| 830 | K | E | 0.322976082 | 0.171606667 |
| 193 | — | LD | 0.322600674 | 0.167338288 |
| 350 | V | A | 0.32248331 | 0.252994511 |
| 786 | L | Q | 0.32241581 | 0.22201146 |
| 4 | K | M | 0.32231147 | 0.124043743 |
| 781 | W | R | 0.322196176 | 0.263818038 |
| 182 | T | I | 0.322044203 | 0.109310181 |
| 888 | R | G | 0.322001059 | 0.172130189 |
| 388 | K | N | 0.321769292 | 0.13958088 |
| 504 | D | Y | 0.321517406 | 0.182186572 |
| 260 | R | I | 0.321461619 | 0.146534668 |
| 695 | E | Q | 0.321451268 | 0.199405121 |
| 960 | T | A | 0.321351275 | 0.243570837 |
| 496 | I | F | 0.321275456 | 0.162860461 |
| 454 | D | H | 0.321034191 | 0.123925099 |
| 859 | Q | H | 0.321009248 | 0.15665955 |
| 432 | S | I | 0.32093586 | 0.219919612 |
| 120 | E | Q | 0.320905282 | 0.134126668 |
| 359 | E | [stop] | 0.320840565 | 0.172779106 |
| 474 | E | [stop] | 0.320753733 | 0.198938474 |
| 609 | K | R | 0.320654761 | 0.097190768 |
| 654 | L | P | 0.320340402 | 0.21351518 |
| 344 | W | G | 0.32013599 | 0.133467654 |
| 629 | E | D | 0.319764058 | 0.097801219 |
| 631 | A | D | 0.319695703 | 0.120854121 |
| 124 | S | Y | 0.319588026 | 0.148095027 |
| 244 | Q | R | 0.319581236 | 0.174412151 |
| 338 | A | D | 0.319500211 | 0.171228389 |
| 634 | V | L | 0.3194918 | 0.113193905 |
| 91 | D | N | 0.319468455 | 0.231799127 |
| 740 | D | E | 0.319148668 | 0.093677265 |
| 942 | K | R | 0.319440348 | 0.184998826 |
| 146 | D | Y | 0.319268754 | 0.209601725 |
| 513 | N | K | 0.319264079 | 0.180017602 |
| 366 | Q | H | 0.318971922 | 0.184226775 |
| 477 | R | G | 0.318963003 | 0.179227033 |
| 947 | K | R | 0.318930494 | 0.25585521 |
| 478 | C | S | 0.318576968 | 0.151506435 |
| 443 | S | G | 0.318453544 | 0.181417518 |
| 766 | K | E | 0.318255467 | 0.119279294 |
| 557 | T | S | 0.318254881 | 0.136960287 |
| 39 | D | E | 0.318241109 | 0.177504749 |
| 586 | A | S | 0.318046156 | 0.197164692 |
| 270 | A | P | 0.317952258 | 0.133471459 |
| 707 | A | S | 0.317797903 | 0.176472631 |
| 173 | K | N | 0.317699885 | 0.158843579 |
| 676 | P | R | 0.317616441 | 0.273323665 |
| 409 | H | N | 0.31739526 | 0.238962249 |
| 878 | N | D | 0.317341485 | 0.123856244 |
| 967 | K | E | 0.317328223 | 0.198885809 |
| 405 | L | M | 0.317316848 | 0.232382071 |
| 759 | R | I | 0.317284234 | 0.210047842 |
| 505 | I | M | 0.317274558 | 0.129635964 |
| 612 | N | D | 0.317252502 | 0.181380961 |
| 862 | V | A | 0.317158438 | 0.090072044 |
| 295 | -N | LS | 0.317076665 | 0.155046903 |
| 165 | R | G | 0.317047785 | 0.17842685 |
| 760 | G | D | 0.316786277 | 0.162885521 |
| 244 | Q | K | 0.316600083 | 0.246636704 |
| 238 | S | Y | 0.316596499 | 0.171458712 |

TABLE 6-continued

Fold enrichment of CasX DME Variants

| Pos. | Ref. | Alt. | Med. Enrich. | 95% CI |
|---|---|---|---|---|
| 475 | F | L | 0.316549309 | 0.192939087 |
| 829 | K | N | 0.316494901 | 0.154808851 |
| 28 | M | I | 0.31630177 | 0.188404934 |
| 186 | G | A | 0.316262682 | 0.1767869 |
| 679 | R | G | 0.316180477 | 0.112760057 |
| 925 | A | G | 0.315901657 | 0.192750307 |
| 892 | A | P | 0.315901657 | 0.129374073 |
| 642 | E | A | 0.315758891 | 0.205380131 |
| 629 | E | G | 0.315702888 | 0.119743865 |
| 642 | E | G | 0.315673565 | 0.11044042 |
| 104 | P | R | 0.315607101 | 0.202791238 |
| 807 | K | E | 0.315573228 | 0.117464708 |
| 599 | D | E | 0.315416693 | 0.115740153 |
| 94 | G | A | 0.315344942 | 0.125574217 |
| 509 | S | R | 0.315237336 | 0.198196247 |
| 715 | A | S | 0.314795788 | 0.184022977 |
| 639 | E | G | 0.314490675 | 0.131536259 |
| 485 | W | R | 0.314444162 | 0.077460473 |
| 529 | Y | [stop] | 0.314338149 | 0.096977512 |
| 773 | R | M | 0.314128132 | 0.191934874 |
| 227 | A | D | 0.313893012 | 0.086820124 |
| 865 | L | V | 0.313870986 | 0.093939035 |
| 25 | T | S | 0.313828907 | 0.165926738 |
| 206 | H | R | 0.313540953 | 0.153060153 |
| 33 | V | I | 0.313378588 | 0.092743144 |
| 736 | N | S | 0.313292021 | 0.139875641 |
| 613 | G | A | 0.313219371 | 0.139952239 |
| 472 | K | R | 0.313201874 | 0.163543589 |
| 149 | — | KPH | 0.313073613 | 0.111009375 |
| 966 | R | I | 0.313069041 | 0.220268045 |
| 847 | E | [stop] | 0.312986862 | 0.248850102 |
| 892 | A | V | 0.312917635 | 0.236911004 |
| 322 | L | P | 0.312907638 | 0.167614176 |
| 947 | K | N | 0.312809501 | 0.23804854 |
| 820 | D | Y | 0.312669916 | 0.196444965 |
| 627 | Q | E | 0.312477809 | 0.180929549 |
| 20 | K | T | 0.312450252 | 0.306509245 |
| 914 | C | G | 0.312434698 | 0.246328459 |
| 793 | S | G | 0.312385644 | 0.182436917 |
| 411 | P | D | 0.312132984 | 0.213313342 |
| 901 | S | R | 0.311953255 | 0.163461395 |
| 393 | F | L | 0.311946018 | 0.192991506 |
| 757 | L | P | 0.311927617 | 0.117197609 |
| 702 | R | G | 0.311688104 | 0.266620819 |
| 589 | K | R | 0.311588343 | 0.136320933 |
| 717 | G | R | 0.311565735 | 0.080863714 |
| 286 | T | S | 0.311321567 | 0.240949263 |
| 150 | P | T | 0.311291496 | 0.13427262 |
| 578 | P | A | 0.311263999 | 0.106013626 |
| 41 | R | G | 0.311016733 | 0.286865829 |
| 781 | W | S | 0.310870839 | 0.281958829 |
| 382 | S | I | 0.310857774 | 0.22558917 |
| 723 | A | T | 0.310856537 | 0.118165477 |
| 451 | A | G | 0.310527551 | 0.159640493 |
| 568 | P | L | 0.310447286 | 0.186724922 |
| 216 | G | S | 0.310362762 | 0.143843218 |
| 216 | G | R | 0.310272111 | 0.119909677 |
| 89 | Q | R | 0.310167676 | 0.139047602 |
| 433 | K | R | 0.310161393 | 0.097615554 |
| 21 | KA | NC | 0.310061242 | 0.098851828 |
| 141 | L | P | 0.309573602 | 0.118441502 |
| 425 | D | Y | 0.309531408 | 0.253195982 |
| 579 | N | D | 0.309484128 | 0.137585893 |
| 825 | L | V | 0.309431153 | 0.160157183 |
| 464 | I | M | 0.309049855 | 0.208541437 |
| 710 | V | L | 0.309047105 | 0.126001585 |
| 671 | D | H | 0.309035221 | 0.209514286 |
| 735 | R | P | 0.309028904 | 0.132025621 |
| 819 | A | G | 0.308778739 | 0.188847749 |
| 2 | E | G | 0.308512084 | 0.159248809 |
| 109 | Q | H | 0.308384304 | 0.180580793 |
| 66 | L | V | 0.308337109 | 0.160085063 |
| 93 | V | L | 0.308334538 | 0.186355769 |
| 621 | Y | [stop] | 0.308307714 | 0.182192979 |
| 0 | M | L | 0.308276685 | 0.236934633 |
| 857 | K | E | 0.308118374 | 0.128063493 |

TABLE 6-continued

Fold enrichment of CasX DME Variants

| Pos. | Ref. | Alt. | Med. Enrich. | 95% CI |
|---|---|---|---|---|
| 264 | L | I | 0.308089176 | 0.231951197 |
| 646 | S | T | 0.307934288 | 0.163215891 |
| 461 | S | T | 0.307923977 | 0.13026743 |
| 937 | S | N | 0.307902696 | 0.280386833 |
| 774 | Q | L | 0.30782826 | 0.179585187 |
| 427 | K | N | 0.307771318 | 0.212433986 |
| 422 | E | G | 0.307743696 | 0.21393123 |
| 107 | I | L | 0.307707331 | 0.205313283 |
| 776 | T | A | 0.307705621 | 0.113209696 |
| 306 | L | V | 0.307515106 | 0.116397313 |
| 651 | P | I | 0.307457933 | 0.189846398 |
| 155 | F | Y | 0.307385155 | 0.165676404 |
| 229 | S | I | 0.307373154 | 0.086318269 |
| 517 | I | V | 0.307363772 | 0.108604289 |
| 334 | V | A | 0.306982037 | 0.139604112 |
| 614 | R | K | 0.306921623 | 0.187827913 |
| 824 | V | L | 0.306719384 | 0.210851946 |
| 723 | A | V | 0.306692766 | 0.140247988 |
| 711 | E | G | 0.306675894 | 0.224133351 |
| 499 | E | Q | 0.306671973 | 0.224590082 |
| 104 | P | S | 0.306640385 | 0.162249455 |
| 3 | I | L | 0.306608196 | 0.194776786 |
| 702 | R | K | 0.306541295 | 0.149431609 |
| 954 | K | E | 0.306525004 | 0.187285491 |
| 842 | — | KEL | 0.306410776 | 0.206532128 |
| 466 | G | C | 0.30635382 | 0.179163452 |
| 979 | — | VSSKD (SEQ ID NO: 3673) | 0.306277048 | 0.179502088 |
| 830 | K | [stop] | 0.306086752 | 0.154175951 |
| 243 | Y | F | 0.306073033 | 0.15669665 |
| 88 | F | L | 0.305867737 | 0.156711191 |
| 149 | K | E | 0.305762803 | 0.092392237 |
| 102 | P | H | 0.305663323 | 0.198476248 |
| 554 | — | RFYI (SEQ ID NO: 3716) | 0.305511625 | 0.122801047 |
| 720 | — | R | 0.305347434 | 0.161540535 |
| 128 | A | G | 0.305254739 | 0.159245241 |
| 122 | L | P | 0.305222365 | 0.154910099 |
| 792 | P | S | 0.305214901 | 0.160903917 |
| 312 | L | P | 0.305192803 | 0.183880511 |
| 299 | Q | [stop] | 0.305119863 | 0.096364942 |
| 668 | A | T | 0.305069729 | 0.135204642 |
| 639 | E | Q | 0.304680843 | 0.266883075 |
| 812 | C | [stop] | 0.304671385 | 0.223383408 |
| 856 | — | YK | 0.304562199 | 0.117931145 |
| 959 | — | ETWQSFY (SEQ ID NO: 3717) | 0.304562199 | 0.204359044 |
| 640 | R | [stop] | 0.304365031 | 0.131009317 |
| 968 | KL | S[stop] | 0.304328899 | 0.221090558 |
| 24 | K | N | 0.304215048 | 0.239991354 |
| 858 | R | T | 0.304052714 | 0.1448623 |
| 530 | L | M | 0.303970715 | 0.250168829 |
| 269 | S | R | 0.303928294 | 0.209763505 |
| 251 | Q | E | 0.303459913 | 0.190095434 |
| 340 | E | Q | 0.30343193 | 0.10804688 |
| 623 | — | R | 0.303430789 | 0.233394445 |
| 880 | D | Y | 0.30324465 | 0.244720194 |
| 223 | P | A | 0.303031527 | 0.177373299 |
| 899 | R | T | 0.302967154 | 0.112177355 |
| 60 | N | D | 0.30295183 | 0.177064719 |
| 966 | R | S | 0.302926375 | 0.099801177 |
| 687 | P | A | 0.302859855 | 0.188291569 |
| 821 | Y | C | 0.302780706 | 0.154234626 |
| 628 | D | Y | 0.302709978 | 0.176578494 |
| 952 | — | TDKRAFVE (SEQ ID NO: 3718) | 0.302629733 | 0.089246659 |
| 540 | L | V | 0.302623885 | 0.094608809 |
| 855 | R | T | 0.302608606 | 0.19469877 |
| 59 | S | I | 0.302606901 | 0.165051866 |
| 272 | G | D | 0.302541592 | 0.185286895 |
| 284 | P | H | 0.302498547 | 0.213421981 |
| 342 | — | TS | 0.302413033 | 0.240972915 |
| 43 | R | W | 0.302283296 | 0.149981215 |
| 760 | G | A | 0.302207311 | 0.130376601 |
| 766 | K | N | 0.302181165 | 0.136382512 |
| 962 | Q | R | 0.302114892 | 0.192863031 |

TABLE 6-continued

Fold enrichment of CasX DME Variants

| Pos. | Ref. | Alt. | Med. Enrich. | 95% CI |
|---|---|---|---|---|
| 656 | G | S | 0.301941181 | 0.160658808 |
| 526 | L | P | 0.301907253 | 0.200130867 |
| 181 | V | L | 0.301627326 | 0.141701986 |
| 602 | S | G | 0.301374384 | 0.168690577 |
| 2 | E | K | 0.301361669 | 0.293245611 |
| 46 | N | S | 0.301357514 | 0.121526311 |
| 71 | T | S | 0.301285774 | 0.182156883 |
| 887 | G | D | 0.301271887 | 0.117733719 |
| 121 | R | S | 0.301231571 | 0.167844846 |
| 108 | D | V | 0.301094262 | 0.261979025 |
| 979 | LE[stop]GS-PGi (SEQ ID NO: 3674) | VSSKDLQA (SEQ ID NO: 3671)[stop] | 0.301043 | 0.222937332 |
| 73 | Y | [stop] | 0.300976299 | 0.109164204 |
| 645 | D | H | 0.300832783 | 0.189820783 |
| 972 | — | VWK | 0.300386808 | 0.146545616 |
| 127 | F | S | 0.300342022 | 0.146847301 |
| 571 | V | A | 0.300337937 | 0.156010497 |
| 386 | D | N | 0.300273532 | 0.259491112 |
| 381 | L | M | 0.300116697 | 0.157006178 |
| 493 | P | A | 0.299995588 | 0.227049942 |
| 199 | H | R | 0.299830107 | 0.074234175 |
| 642 | E | [stop] | 0.299768631 | 0.20842894 |
| 352 | K | [stop] | 0.299555207 | 0.106916877 |
| 314 | I | V | 0.299339024 | 0.237860572 |
| 696 | S | T | 0.299269551 | 0.19370537 |
| 554 | R | G | 0.299260223 | 0.263070996 |
| 413 | W | S | 0.298889603 | 0.120871006 |
| 973 | W | [stop] | 0.298886432 | 0.173734887 |
| 1 | Q | [stop] | 0.298848883 | 0.253324527 |
| 59 | S | G | 0.298416382 | 0.178538741 |
| 717 | G | [stop] | 0.298317755 | 0.217662606 |
| 348 | C | S | 0.298274049 | 0.13599769 |
| 707 | A | G | 0.298173789 | 0.189062395 |
| 478 | CE | AQ | 0.298056287 | 0.28697996 |
| 915 | G | A | 0.298020743 | 0.21282862 |
| 969 | L | M | 0.297993119 | 0.288243926 |
| 953 | D | V | 0.297929214 | 0.145206254 |
| 485 | W | G | 0.297911414 | 0.242181721 |
| 676 | P | A | 0.297863971 | 0.0896.40148 |
| 4 | K | T | 0.297828559 | 0.161108285 |
| 631 | A | G | 0.297777083 | 0.103836414 |
| 250 | H | P | 0.29766948 | 0.081415922 |
| 11 | — | R | 0.29755173 | 0.242218951 |
| 274 | A | T | 0.297540582 | 0.172279995 |
| 918 | T | K | 0.297381988 | 0.249593921 |
| 43 | R | L | 0.297375059 | 0.247052829 |
| 51 | P | A | 0.29736536 | 0.241677851 |
| 64 | A | T | 0.297190007 | 0.136022098 |
| 617 | E | Q | 0.297156994 | 0.256789508 |
| 468 | — | K | 0.297121715 | 0.218726347 |
| 705 | Q | [stop] | 0.297097391 | 0.129530594 |
| 538 | G | D | 0.297030166 | 0.143641253 |
| 697 | Y | [stop] | 0.29694611 | 0.165401562 |
| 30 | T | N | 0.296922856 | 0.20113666 |
| 374 | Q | E | 0.296916876 | 0.294201034 |
| 429 | E | G | 0.296692622 | 0.12956891 |
| 617 | E | G | 0.296673186 | 0.100617287 |
| 174 | P | L | 0.296325925 | 0.125090192 |
| 476 | C | W | 0.296243077 | 0.108583652 |
| 536 | K | [stop] | 0.296174047 | 0.204485045 |
| 340 | E | [stop] | 0.296106359 | 0.228363644 |
| 263 | N | S | 0.295761788 | 0.153417105 |
| 292 | A | D | 0.295588873 | 0.132003236 |
| 524 | K | E | 0.295588726 | 0.123024834 |
| 252 | K | E | 0.295509892 | 0.130412924 |
| 360 | D | H | 0.295426779 | 0.169820671 |
| 771 | A | T | 0.295409018 | 0.21146028 |
| 960 | T | S | 0.295303172 | 0.200733126 |
| 345 | D | Y | 0.295298688 | 0.153403354 |
| 469 | E | G | 0.295269456 | 0.193145904 |
| 495 | A | T | 0.295248074 | 0.179130836 |
| 929 | A | G | 0.295233981 | 0.250007265 |
| 435 | I | T | 0.2952095 | 0.10707736 |
| 586 | A | T | 0.295123473 | 0.125804414 |
| 627 | Q | R | 0.295089748 | 0.147312376 |

TABLE 6-continued

Fold enrichment of CasX DME Variants

| Pos. | Ref. | Alt. | Med. Enrich. | 95% CI |
|---|---|---|---|---|
| 17 | S | I | 0.295022842 | 0.203345294 |
| 96 | M | V | 0.29492941 | 0.118289949 |
| 83 | V | M | 0.294841632 | 0.151911965 |
| 721 | K | [stop] | 0.294783263 | 0.121804362 |
| 550 | F | S | 0.294772324 | 0.160417343 |
| 538 | G | A | 0.294474804 | 0.174345187 |
| 462 | F | L | 0.294742725 | 0.14185505 |
| 822 | D | H | 0.294658575 | 0.162957386 |
| 213 | QI | PV | 0.294575907 | 0.193654125 |
| 658 | D | N | 0.294502464 | 0.107952026 |
| 309 | W | S | 0.294338009 | 0.284836107 |
| 835 | W | C | 0.294317109 | 0.120763755 |
| 607 | S | V | 0.294194742 | 0.192145848 |
| 853 | Y | [stop] | 0.294188525 | 0.116100881 |
| 895 | L | M | 0.294152124 | 0.189733578 |
| 298 | AQ | DR | 0.294067945 | 0.080730567 |
| 221 | S | T | 0.293988985 | 0.161830985 |
| 854 | — | NRYKRQ (SEQ ID NO: 3719) | 0.29389502 | 0.164228467 |
| 184 | — | SLG | 0.29389502 | 0.133943716 |
| 24 | K | E | 0.293893146 | 0.087429384 |
| 903 | R | T | 0.293855808 | 0.156130706 |
| 649 | I | M | 0.293844709 | 0.213121389 |
| 646 | S | N | 0.293718938 | 0.053702828 |
| 751 | M | T | 0.293692865 | 0.188828745 |
| 138 | V | A | 0.293692865 | 0.172441917 |
| 421 | W | R | 0.293643119 | 0.202965718 |
| 885 | T | A | 0.293639992 | 0.136222429 |
| 372 | K | N | 0.293601801 | 0.159631501 |
| 899 | R | W | 0.293409271 | 0.197663789 |
| 323 | Q | R | 0.293396269 | 0.187618952 |
| 787 | A | V | 0.293181255 | 0.111256021 |
| 97 | S | G | 0.29311892 | 0.120983434 |
| 523 | V | A | 0.293107836 | 0.144403198 |
| 606 | GS | -A | 0.293095145 | 0.176419666 |
| 647 | S | G | 0.293070849 | 0.180316262 |
| 401 | L | M | 0.293059235 | 0.238931791 |
| 706 | A | T | 0.293004089 | 0.157196701 |
| 167 | I | M | 0.292976512 | 0.174801994 |
| 239 | F | Y | 0.292846447 | 0.244049066 |
| 532 | I | M | 0.292790974 | 0.132047771 |
| 362 | K | N | 0.292779584 | 0.196868197 |
| 531 | I | F | 0.292690193 | 0.245999103 |
| 551 | E | D | 0.292676692 | 0.177028816 |
| 366 | Q | R | 0.292637285 | 0.233099785 |
| 45 | E | K | 0.292602703 | 0.135241306 |
| 170 | S | P | 0.292187757 | 0.117055288 |
| 522 | — | GVKKLNLY (SEQ ID NO: 3720) | 0.292477218 | 0.205588046 |
| 184 | S | T | 0.292461578 | 0.171099938 |
| 256 | K | R | 0.292459664 | 0.134546625 |
| 898 | K | R | 0.292371281 | 0.233917307 |
| 687 | — | PTHILR (SEQ ID NO: 3721) | 0.292237604 | 0.252992689 |
| 499 | E | [stop] | 0.292180944 | 0.205912614 |
| 439 | E | [stop] | 0.291789527 | 0.178224776 |
| 286 | T | I | 0.291597253 | 0.134630039 |
| 326 | K | R | 0.291167908 | 0.130858044 |
| 309 | W | C | 0.291117426 | 0.126634127 |
| 141 | L | V | 0.291053469 | 0.125358393 |
| 599 | D | H | 0.290990101 | 0.194898673 |
| 891 | E | D | 0.290888227 | 0.199229012 |
| 663 | I | T | 0.290884576 | 0.159824412 |
| 86 | E | G | 0.290735509 | 0.164271816 |
| 950 | — | GNTDKRA (SEQ ID NO: 3722) | 0.290646329 | 0.08439848 |
| 910 | V | A | 0.290614659 | 0.192165123 |
| 130 | S | R | 0.290579337 | 0.126556505 |
| 286 | T | A | 0.290569747 | 0.161258253 |
| 412 | D | Y | 0.290563856 | 0.192946257 |
| 390 | G | C | 0.290531408 | 0.226107283 |
| 96 | M | T | 0.290483084 | 0.117441458 |
| 796 | Y | F | 0.290480726 | 0.145066767 |
| 617 | E | [stop] | 0.290459043 | 0.254049857 |
| 520 | K | Q | 0.290432231 | 0.149193863 |
| 238 | S | C | 0.29036146 | 0.125809391 |

TABLE 6-continued

Fold enrichment of CasX DME Variants

| Pos. | Ref. | Alt. | Med. Enrich. | 95% CI |
|---|---|---|---|---|
| 510 | K | N | 0.290307315 | 0.121616244 |
| 751 | M | I | 0.290086322 | 0.117481113 |
| 764 | Q | E | 0.290043861 | 0.213865459 |
| 239 | F | L | 0.290032145 | 0.120563078 |
| 750 | A | S | 0.290021488 | 0.169783417 |
| 509 | S | N | 0.290010303 | 0.173158694 |
| 791 | L | V | 0.28993006 | 0.240441646 |
| 976 | A | P | 0.289917569 | 0.129909297 |
| 970 | K | E | 0.289792346 | 0.088055606 |
| 370 | G | S | 0.289754414 | 0.116500268 |
| 229 | S | I | 0.289718863 | 0.192569781 |
| 126 | G | S | 0.289695476 | 0.136718855 |
| 39 | D | H | 0.28966543 | 0.205820796 |
| 541 | R | W | 0.289647451 | 0.149474595 |
| 963 | S | R | 0.289642486 | 0.119359764 |
| 614 | R | G | 0.289631701 | 0.096593744 |
| 903 | R | K | 0.289598509 | 0.276955136 |
| 700 | K | E | 0.289582689 | 0.146563937 |
| 176 | A | T | 0.289565984 | 0.071489526 |
| 714 | R | G | 0.289551118 | 0.131217053 |
| 849 | Q | E | 0.289450204 | 0.14256548 |
| 861 | V | L | 0.289424991 | 0.184715842 |
| 227 | A | S | 0.289407395 | 0.147147965 |
| 337 | Q | E | 0.289400311 | 0.154536453 |
| 282 | P | Q | 0.289371748 | 0.241776764 |
| 147 | — | KGKPH (SEQ ID NO: 3723) | 0.289327222 | 0.167067239 |
| 215 | — | GGNSCASG (SEQ ID NO: 3724) | 0.28926976 | 0.113347286 |
| 615 | — | Q | 0.288918789 | 0.138819471 |
| 148 | — | GKPHTNY (SEQ ID NO: 3725) | 0.288918789 | 0.145077971 |
| 70 | L | V | 0.288897546 | 0.141249384 |
| 131 | Q | H | 0.28889109 | 0.089984222 |
| 417 | Y | [stop] | 0.288830461 | 0.139069155 |
| 917 | P | Q | 0.288684907 | 0.209421131 |
| 681 | K | R | 0.288657171 | 0.188212382 |
| 824 | — | VLE | 0.288568311 | 0.142383803 |
| 757 | L | M | 0.288547614 | 0.138199941 |
| 683 | S | P | 0.288449161 | 0.100064584 |
| 879 | N | D | 0.288359669 | 0.112916417 |
| 87 | EF | AV | 0.28833835 | 0.157423397 |
| 623 | R | M | 0.288312668 | 0.180378091 |
| 360 | D | G | 0.288240177 | 0.1450193 |
| 469 | E | D | 0.288213424 | 0.169330277 |
| 488 | D | H | 0.288056714 | 0.224399768 |
| 832 | A | D | 0.28797086 | 0.133987122 |
| 331 | F | L | 0.287898632 | 0.125465761 |
| 880 | D | N | 0.287796432 | 0.265861692 |
| 813 | G | V | 0.28764847 | 0.18793522 |
| 125 | S | R | 0.287612867 | 0.078156909 |
| 315 | G | V | 0.287582891 | 0.216366011 |
| 862 | V | L | 0.28755723 | 0.122530143 |
| 376 | A | D | 0.287488687 | 0.149852687 |
| 717 | G | A | 0.287475979 | 0.138371481 |
| 871 | R | G | 0.287423469 | 0.12544588 |
| 779 | P | [stop] | 0.287388451 | 0.214465092 |
| 659 | R | Q | 0.287382153 | 0.188389105 |
| 688 | T | S | 0.2872606 | 0.18090055 |
| 450 | A | G | 0.287222025 | 0.226851871 |
| 608 | L | P | 0.287206606 | 0.153956956 |
| 74 | T | A | 0.28708898 | 0.151009591 |
| 101 | Q | H | 0.287075864 | 0.127870371 |
| 168 | L | M | 0.287051161 | 0.164606192 |
| 522 | G | A | 0.286889556 | 0.191392288 |
| 158 | — | CN | 0.286856801 | 0.104191954 |
| 822 | D | Y | 0.286792384 | 0.216414998 |
| 31 | LL | PV | 0.286704233 | 0.167404084 |
| 753 | — | IFENLS (SEQ ID NO: 3726) | 0.286664247 | 0.204891377 |
| 894 | — | SLLK (SEQ ID NO: 3727) | 0.286588033 | 0.088926565 |
| 443 | S | R | 0.286575868 | 0.16053834 |
| 813 | G | S | 0.286517663 | 0.166687094 |
| 545 | I | T | 0.28643634 | 0.175437623 |
| 43 | R | G | 0.286322337 | 0.211707784 |

TABLE 6-continued

| Fold enrichment of CasX DME Variants | | | | |
|---|---|---|---|---|
| Pos. | Ref. | Alt. | Med. Enrich. | 95% CI |
| 671 | D | G | 0.28629192 | 0.163952723 |
| 501 | S | T | 0.286282753 | 0.120251174 |
| 729 | L | M | 0.286200559 | 0.141100837 |
| 264 | L | F | 0.28603772 | 0.148836446 |
| 613 | G | P | 0.285821749 | 0.213295055 |
| 806 | S | P | 0.285754508 | 0.139734573 |
| 251 | Q | R | 0.285704309 | 0.129794167 |
| 503 | L | P | 0.285623626 | 0.150765257 |
| 544 | K | N | 0.285528499 | 0.105740594 |
| 685 | G | S | 0.285482686 | 0.116956671 |
| 66 | L | P | 0.285241304 | 0.178235911 |
| 348 | C | [stop] | 0.285167016 | 0.232120541 |
| 615 | V | L | 0.285139566 | 0.138644746 |
| 34 | R | K | 0.285068253 | 0.155629412 |
| 606 | G | D | 0.284708065 | 0.131937418 |
| 564 | G | R | 0.284584869 | 0.153328649 |
| 767 | R | G | 0.284520477 | 0.167110905 |
| 459 | K | N | 0.284319069 | 0.144116629 |
| 100 | A | G | 0.284064196 | 0.232698011 |
| 182 | T | S | 0.284017418 | 0.165066704 |
| 552 | A | P | 0.28399207 | 0.192922882 |
| 874 | E | [stop] | 0.283924403 | 0.212096559 |
| 656 | G | V | 0.283837412 | 0.096364514 |
| 527 | N | D | 0.283828964 | 0.095606466 |
| 560 | N | D | 0.283827293 | 0.131100485 |
| 518 | W | [stop] | 0.283768829 | 0.144873432 |
| 900 | F | Y | 0.283754684 | 0.18210141 |
| 485 | W | C | 0.283722783 | 0.101623525 |
| 528 | L | M | 0.283582823 | 0.241404553 |
| 463 | V | L | 0.283409253 | 0.174572622 |
| 938 | Q | R | 0.283399277 | 0.159588016 |
| 809 | C | R | 0.2832933 | 0.140866937 |
| 765 | G | V | 0.283226034 | 0.181883423 |
| 253 | V | E | 0.283192966 | 0.158310209 |
| 745 | A | D | 0.283094632 | 0.139036808 |
| 739 | R | S | 0.283000418 | 0.086394522 |
| 262 | A | D | 0.282981572 | 0.21883829 |
| 75 | E | D | 0.282861668 | 0.096240394 |
| 122 | L | V | 0.28282995 | 0.142431105 |
| 427 | K | R | 0.282689541 | 0.126741896 |
| 472 | K | E | 0.282354225 | 0.243592384 |
| 69 | L | V | 0.282311609 | 0.233097353 |
| 128 | A | D | 0.282136746 | 0.144684711 |
| 240 | L | P | 0.282112821 | 0.187484636 |
| 840 | N | D | 0.28205862 | 0.169019904 |
| 496 | I | L | 0.281766947 | 0.156440465 |
| 713 | R | [stop] | 0.281751627 | 0.150509506 |
| 759 | R | I | 0.281715415 | 0.207490665 |
| 103 | A | D | 0.281654023 | 0.156258821 |
| 352 | K | R | 0.281644749 | 0.090972271 |
| 23 | G | D | 0.281613067 | 0.110087313 |
| 490 | R | I | 0.28158749 | 0.189681 |
| 534 | Y | C | 0.281578683 | 0.19797794 |
| 728 | N | K | 0.281567938 | 0.122533743 |
| 218 | S | G | 0.28156304 | 0.0827746 |
| 131 | Q | K | 0.28143462 | 0.261996702 |
| 117 | D | Y | 0.281261616 | 0.150312544 |
| 809 | C | S | 0.281246687 | 0.119977311 |
| 899 | R | S | 0.281103794 | 0.115069396 |
| 192 | A | P | 0.281083951 | 0.125030936 |
| 913 | N | S | 0.280977138 | 0.259159821 |
| 232 | C | S | 0.28083211 | 0.170644437 |
| 928 | I | L | 0.280808974 | 0.249623753 |
| 495 | A | G | 0.280579997 | 0.166279564 |
| 917 | — | ETHAA (SEQ ID NO: 3728) | 0.280544768 | 0.259917773 |
| 85 | W- | LS | 0.280472053 | 0.101385815 |
| 344 | W | [stop] | 0.280246002 | 0.139860723 |
| 493 | P | H | 0.280219202 | 0.225933372 |
| 189 | G | A | 0.28010846 | 0.181165246 |
| 565 | E | G | 0.28010846 | 0.126376781 |
| 944 | Q | R | 0.279992746 | 0.221800854 |
| 674 | G | A | 0.27982066 | 0.112736684 |
| 45 | E | V | 0.279758496 | 0.126165976 |
| 281 | P | A | 0.27973122 | 0.169207983 |
| 828 | L | P | 0.279653349 | 0.165044194 |

TABLE 6-continued

| Fold enrichment of CasX DME Variants | | | | |
|---|---|---|---|---|
| Pos. | Ref. | Alt. | Med. Enrich. | 95% CI |
| 460 | A | D | 0.27950426 | 0.185233285 |
| 539 | K | R | 0.279423784 | 0.231876099 |
| 62 | S | G | 0.279325036 | 0.105769252 |
| 883 | S | T | 0.278909433 | 0.17133128 |
| 166 | — | LIL | 0.27890183 | 0.114735325 |
| 445 | D | N | 0.27879.438 | 0.120139275 |
| 121 | R | G | 0.278752599 | 0.152495589 |
| 66 | LN | PV | 0.278503247 | 0.058556198 |
| 603 | — | LETGSLK (SEQ ID NO: 3729) | 0.278503247 | 0.20379117 |
| 225 | G | [stop] | 0.278489806 | 0.182580993 |
| 175 | — | EAN | 0.278488851 | 0.117512649 |
| 274 | A | S | 0.278435433 | 0.213434648 |
| 870 | D | G | 0.278347965 | 0.136371883 |
| 683 | S | T | 0.278234202 | 0.119170388 |
| 792 | P | H | 0.277909356 | 0.196357382 |
| 18 | N | R | 0.277904726 | 0.144376969 |
| 484 | K | R | 0.277812806 | 0.156918996 |
| 51 | P | H | 0.27780081 | 0.207949147 |
| 549 | A | D | 0.277618034 | 0.184792104 |
| 285 | H | Q | 0.277595201 | 0.164383067 |
| 772 | E | [stop] | 0.277569205 | 0.252009775 |
| 233 | M | T | 0.277522281 | 0.101460422 |
| 677 | — | LSRFKDS (SEQ ID NO: 3730) | 0.277439144 | 0.176461932 |
| 444 | E | D | 0.277438575 | 0.185715982 |
| 287 | K | R | 0.277424076 | 0.122002352 |
| 86 | E | Q | 0.277422525 | 0.267475322 |
| 650 | K | R | 0.277338051 | 0.1661601 |
| 119 | N | K | 0.2772012 | 0.097660237 |
| 419 | E | D | 0.27717758 | 0.091079949 |
| 849 | Q | H | 0.277146577 | 0.10057266 |
| 745 | A | P | 0.277094424 | 0.180486538 |
| 895 | L | V | 0.277059576 | 0.147621158 |
| 200 | V | R | 0.276947529 | 0.109871945 |
| 491 | G | A | 0.276923451 | 0.236639042 |
| 437 | L | P | 0.276817656 | 0.127643327 |
| 794 | K | E | 0.276808052 | 0.108760175 |
| 553 | N | K | 0.276534729 | 0.129122139 |
| 500 | N | K | 0.276479484 | 0.0753.42066 |
| 796 | Y | [stop] | 0.276459628 | 0.151040972 |
| 313 | K | E | 0.276424062 | 0.141250225 |
| 184 | S | R | 0.276360484 | 0.093462218 |
| 770 | M | V | 0.276349013 | 0.177344184 |
| 30 | T | S | 0.27626759 | 0.074607362 |
| 887 | G | C | 0.276203171 | 0.205245818 |
| 885 | T | S | 0.276162821 | 0.125136939 |
| 372 | K | E | 0.2761455 | 0.186164615 |
| 161 | S | F | 0.276099268 | 0.101256778 |
| 280 | LP | PV | 0.2760948 | 0.15312325 |
| 118 | G | A | 0.276069076 | 0.158472607 |
| 945 | T | S | 0.275967844 | 0.217091948 |
| 597 | W | S | 0.275959763 | 0.205648781 |
| 700 | K | [stop] | 0.275943939 | 0.231744011 |
| 654 | L | M | 0.275895098 | 0.222206287 |
| 34 | R | I | 0.275728667 | 0.262529033 |
| 650 | K | N | 0.275727906 | 0.092682765 |
| 347 | V | D | 0.275634849 | 0.162043607 |
| 701 | Q | E | 0.275445666 | 0.129639485 |
| 221 | S | P | 0.275424064 | 0.253543179 |
| 902 | H | Y | 0.275413846 | 0.238626124 |
| 408 | K | N | 0.275278915 | 0.187758493 |
| 410 | G | R | 0.275207307 | 0.148329245 |
| 202 | R | T | 0.27519939 | 0.225294793 |
| 190 | Q | H | 0.275101911 | 0.155497318 |
| 296 | V | A | 0.274868513 | 0.216028266 |
| 176 | A | V | 0.274754076 | 0.101747221 |
| 16 | D | V | 0.274707044 | 0.080710216 |
| 338 | A | G | 0.274649181 | 0.21549192 |
| 908 | K | [stop] | 0.274631009 | 0.235774306 |
| 745 | A | I | 0.274596368 | 0.139876086 |
| 582 | I | I | 0.274539152 | 0.136455089 |
| 73 | Y | H | 0.274522926 | 0.183155681 |
| 609 | K | E | 0.274518342 | 0.096584602 |

TABLE 6-continued

Fold enrichment of CasX DME Variants

| Pos. | Ref. | Alt. | Med. Enrich. | 95% CI |
|---|---|---|---|---|
| 148 | — | GKPHT (SEQ ID NO: 3731) | 0.274483854 | 0.138944547 |
|  |  | I | 0.274483065 | 0.167999753 |
| 600 | L | P | 0.274446407 | 0.156944314 |
| 609 | K | N | 0.274296988 | 0.098675974 |
| 548 | E | G | 0.274291628 | 0.174184065 |
| 282 | P | R | 0.274223113 | 0.269615449 |
| 743 | Y | N | 0.274041951 | 0.169744437 |
| 273 | LA | PV | 0.273953381 | 0.083004597 |
| 241 | — | IKYQD (SEQ ID NO: 3732) | 0.273953381 | 0.041697608 |
| 752 | LI | PV | 0.273953381 | 0.179521275 |
| 500 | — | NSILD (SEQ ID NO: 3733) | 0.273953381 | 0.096079618 |
| 88 | EQ | DR | 0.273953381 | 0.132934109 |
| 548 | E | K | 0.273785339 | 0.140999456 |
| 758 | S | T | 0.273170088 | 0.17814745 |
| 884 | W | S | 0.27315778 | 0.127540825 |
| 258 | E | D | 0.273147573 | 0.172394328 |
| 720 | R | M | 0.272984313 | 0.209562405 |
| 217 | N | H | 0.272871217 | 0.212149421 |
| 0 | M | R | 0.272866831 | 0.105028991 |
| 376 | A | G | 0.27284261 | 0.107816996 |
| 221 | S | C | 0.272816553 | 0.204562414 |
| 691 | LR | PV | 0.272779276 | 0.168092844 |
| 796 | YL | DR | 0.272779276 | 0.144849416 |
| 439 | — | EERR (SEQ ID NO: 3734) | 0.272779276 | 0.117493254 |
| 383 | S | N | 0.272651878 | 0.203030872 |
| 603 | L | M | 0.272615876 | 0.2046327 |
| 183 | Y | H | 0.27230417 | 0.167987777 |
| 858 | R | K | 0.272264159 | 0.162833579 |
| 525 | — | KLNLYL (SEQ ID NO: 3735) | 0.272179534 | 0.127115618 |
| 178 | D | H | 0.27217863 | 0.114858223 |
| 186 | G | S | 0.272004663 | 0.206440397 |
| 797 | LS | PV | 0.271846299 | 0.116235959 |
| 434 | H | L | 0.271775834 | 0.108387354 |
| 124 | S | C | 0.271634239 | 0.201362524 |
| 687 | — | PTH (SEQ ID NO: 3736) | 0.271046382 | 0.217907583 |
| 626 | R | I | 0.271037385 | 0.191496316 |
| 717 | G | V | 0.271024109 | 0.162847575 |
| 534 | Y | [stop] | 0.270681224 | 0.104188898 |
| 150 | P | H | 0.270599643 | 0.192362809 |
| 552 | A | S | 0.270597368 | 0.181876059 |
| 150 | P | S | 0.270581156 | 0.14794261 |
| 270 | A | S | 0.270550408 | 0.145246028 |
| 563 | S | Y | 0.270533409 | 0.17681632 |
| 664 | — | PAV | 0.270462826 | 0.090794222 |
| 97 | S | I | 0.270410385 | 0.155670382 |
| 64 | A | D | 0.270367942 | 0.13574281 |
| 143 | Q | E | 0.27021122 | 0.220203083 |
| 686 | N | I | 0.270089028 | 0.228432562 |
| 544 | K | [stop] | 0.270051777 | 0.124983342 |
| 537 | G | A | 0.270050779 | 0.18424231 |
| 902 | H | L | 0.269853978 | 0.238618549 |
| 361 | G | A | 0.269774718 | 0.191146018 |
| 963 | S | C | 0.269617744 | 0.20243244 |
| 965 | Y | H | 0.26944455 | 0.246260675 |
| 66 | — | LNK | 0.269318761 | 0.181427468 |
| 959 | — | ETWQS (SEQ ID NO: 3737) | 0.269318761 | 0.133778085 |
| 509 | — | SKQYN (SEQ ID NO: 3738) | 0.269239232 | 0.199612231 |
| 32 | L | I | 0.269033673 | 0.109933858 |
| 209 | K | N | 0.269020729 | 0.109971766 |
| 48 | R | [stop] | 0.268939151 | 0.082435645 |
| 466 | — | T | 0.268825688 | 0.095723888 |
| 45 | E | Q | 0.268733142 | 0.139266278 |
| 813 | E | Q | 0.268599201 | 0.195661988 |
| 643 | V | L | 0.268577714 | 0.156052892 |
| 285 | H | R | 0.268299231 | 0.21489701 |
| 317 | D | G | 0.268047511 | 0.116283826 |
| 195 | F | L | 0.268015884 | 0.108480308 |
| 590 | R | K | 0.267781681 | 0.208536761 |

TABLE 6-continued

Fold enrichment of CasX DME Variants

| Pos. | Ref. | Alt. | Med. Enrich. | 95% CI |
|---|---|---|---|---|
| 180 | L | V | 0.267694655 | 0.240305187 |
| 21 | KA | TV | 0.267470584 | 0.147038119 |
| 210 | P | H | 0.267434518 | 0.190772597 |
| 612 | N | S | 0.267119306 | 0.129882451 |
| 440 | E | G | 0.267419306 | 0.166870392 |
| 651 | P | L | 0.267350724 | 0.179171164 |
| 686 | — | NPTHILR (SEQ ID NO: 3739) | 0.267281547 | 0.145940038 |
| 56 | Q | E | 0.267209421 | 0.156465006 |
| 656 | G | D | 0.267197717 | 0.143131022 |
| 591 | Q | E | 0.267046259 | 0.172628923 |
| 771 | A | P | 0.266971248 | 0.20146384 |
| 667 | I | N | 0.266893998 | 0.140849994 |
| 333 | L | P | 0.26683779 | 0.202160591 |
| 168 | L | V | 0.266833554 | 0.09646076 |
| 43 | R | R | 0.266528412 | 0.166392391 |
| 76 | M | T | 0.26642278 | 0.06437874 |
| 85 | WE | CC | 0.266335966 | 0.095081027 |
| 784 | A | D | 0.266225364 | 0.186318048 |
| 179 | E | G | 0.266200643 | 0.159572948 |
| 282 | P | T | 0.266142294 | 0.234821238 |
| 505 | I | V | 0.266033676 | 0.153318009 |
| 884 | W | C | 0.265892315 | 0.146379991 |
| 705 | Q | L | 0.265873279 | 0.218762249 |
| 913 | N | I | 0.265873279 | 0.228181021 |
| 775 | V | S | 0.265844485 | 0.132207982 |
| 678 | S | R | 0.265770435 | 0.147977027 |
| 602 | S | R | 0.265750704 | 0.118408744 |
| 121 | R | T | 0.265718915 | 0.126781949 |
| 818 | S | R | 0.265623217 | 0.145609734 |
| 798 | S | C | 0.265584497 | 0.073889024 |
| 864 | — | DLSVEL (SEQ ID NO: 3740) | 0.265506357 | 0.19885122 |
| 373 | R | G | 0.265364174 | 0.162678423 |
| 803 | Q | E | 0.265269725 | 0.202509841 |
| 628 | D | E | 0.265261641 | 0.142156395 |
| 194 | D | N | 0.265249363 | 0.155857424 |
| 336 | R | I | 0.2651284 | 0.181377392 |
| 602 | S | I | 0.265065039 | 0.204267576 |
| 34 | R | S | 0.265026085 | 0.223416007 |
| 775 | y | N | 0.264899495 | 0.150356822 |
| 647 | — | SNIK (SEQ ID NO: 3741) | 0.264896362 | 0.152108713 |
| 369 | A | G | 0.264866639 | 0.127314344 |
| 407 | KKHGEDWG (SEQ ID NO: 3742) | RSTARTGA (SEQ ID NO: 3743) | 0.26465494 | 0.11425501 |
| 117 | D | H | 0.264598341 | 0.092643909 |
| 149 | K | R | 0.26429667 | 0.254633892 |
| 624 | R | S | 0.264277774 | 0.09593797 |
| 526 | L | M | 0.26419728 | 0.176624184 |
| 671 | D | N | 0.264084519 | 0.212711081 |
| 572 | N | K | 0.264075863 | 0.218490453 |
| 949 | T | S | 0.263657544 | 0.110498861 |
| 20 | KKA | T-V | 0.263583848 | 0.126615658 |
| 56 | Q | R | 0.263561421 | 0.151855491 |
| 492 | K | N | 0.263524564 | 0.121563708 |
| 315 | G | D | 0.26350398 | 0.250984577 |
| 625 | I | S | 0.263431268 | 0.11997699 |
| 657 | I | S | 0.26332391 | 0.140695845 |
| 688 | T | R | 0.26332192 | 0.129910161 |
| 835 | W | R | 0.263224631 | 0.136063076 |
| 876 | S | T | 0.262876961 | 0.112192073 |
| 468 | K | R | 0.262863102 | 0.120169191 |
| 590 | — | RQG | 0.26279648 | 0.125412364 |
| 912 | L | R | 0.262679132 | 0.194562045 |
| 222 | G | R | 0.262575495 | 0.121179798 |
| 379 | P | A | 0.262556362 | 0.200217288 |
| 7 | N | Y | 0.262545332 | 0.249153444 |
| 514 | C | R | 0.262528328 | 0.153764358 |
| 964 | — | FY | 0.262491519 | 0.18918584 |
| 951 | N | I | 0.262433241 | 0.181173796 |
| 738 | A | S | 0.262344275 | 0.213159289 |
| 109 | Q | K | 0.262161279 | 0.235829587 |
| 371 | Y | C | 0.262089785 | 0.121531872 |
| 62 | S | I | 0.262062515 | 0.217469036 |

TABLE 6-continued

Fold enrichment of CaSX DME Variants

| Pos. | Ref. | Alt. | Med. Enrich. | 95% CI |
|---|---|---|---|---|
| 967 | K | N | 0.261999761 | 0.11991933 |
| 395 | R | I | 0.261975414 | 0.202071604 |
| 546 | K | E | 0.261933935 | 0.196957538 |
| 473 | D | H | 0.26183541 | 0.210514432 |
| 422 | — | ERIDKIN (SEQ ID NO: 3744) | 0.261766763 | 0.175889641 |
| 661 | E | D | 0.261685468 | 0.21738252 |
| 807 | K | N | 0.261631077 | 0.137745855 |
| 495 | A | P | 0.261336035 | 0.145111761 |
| 474 | E | V | 0.261129255 | 0.1424745 |
| 100 | A | V | 0.261042682 | 0.097040591 |
| 660 | G | A | 0.260992911 | 0.257791059 |
| 613 | G | V | 0.260991628 | 0.142830183 |
| 356 | — | EKK | 0.260606313 | 0.08939761 |
| 419 | E | R | 0.260606313 | 0.127113021 |
| 876 | S | T | 0.262876961 | 0.112192073 |
| 440 | E | [stop] | 0.260572941 | 0.226197983 |
| 245 | D | Y | 0.260411841 | 0.171518027 |
| 838 | T | A | 0.260310871 | 0.127668195 |
| 510 | K | E | 0.260303511 | 0.170827119 |
| 885 | T | I | 0.260229119 | 0.18213929 |
| 606 | G | C | 0.260187776 | 0.249968408 |
| 298 | A | P | 0.260175418 | 0.137767012 |
| 31 | L | R | 0.260094537 | 0.205569477 |
| 19 | T | I | 0.259989986 | 0.207028692 |
| 886 | K | R | 0.259901164 | 0.087667222 |
| 817 | T | S | 0.259831477 | 0.054519088 |
| 901 | S | T | 0.259815097 | 0.082797155 |
| 343 | W | S | 0.259761267 | 0.144643456 |
| 25 | T | R | 0.259617038 | 0.188030957 |
| 238 | S | P | 0.259597922 | 0.12796144 |
| 343 | W | R | 0.259570669 | 0.092335686 |
| 317 | D | Y | 0.259540606 | 0.174340169 |
| 347 | — | VCNVKK (SEQ ID NO: 3745) | 0.259425173 | 0.186479916 |
| 606 | G | S | 0.259379927 | 0.201078104 |
| 879 | N | S | 0.259300679 | 0.19356618 |
| 784 | A | S | 0.259182688 | 0.192685039 |
| 48 | R | I | 0.259088713 | 0.132594855 |
| 112 | L | M | 0.25908476 | 0.122948809 |
| 181 | V | A | 0.259030426 | 0.153412207 |
| 567 | V | M | 0.258972858 | 0.206147057 |
| 787 | A | P | 0.258909575 | 0.199316536 |
| 741 | — | LLY | 0.258835623 | 0.170116186 |
| 280 | — | LP | 0.258711013 | 0.142341042 |
| 639 | — | ERREVLD (SEQ ID NO: 3746) | 0.258711013 | 0.096645952 |
| 11 | RR | AS | 0.258711013 | 0.198257452 |
| 660 | G | V | 0.258707306 | 0.163939116 |
| 62 | S | N | 0.258582734 | 0.206139171 |
| 716 | G | C | 0.258579754 | 0.205579693 |
| 185 | L | M | 0.258521471 | 0.171738368 |
| 407 | K | N | 0.258498581 | 0.130697064 |
| 973 | W | C | 0.258383156 | 0.162271324 |
| 419 | E | [stop] | 0.258326013 | 0.179526252 |
| 457 | R | K | 0.258832368.4 | 0.189885325 |
| 876 | S | R | 0.258284608 | 0.118534232 |
| 19 | T | S | 0.258270715 | 0.163493921 |
| 680 | F | S | 0.258237866 | 0.129529513 |
| 2 | E | A | 0.257800465 | 0.161538463 |
| 20 | K | D | 0.257606921 | 0.080857215 |
| 481 | K | E | 0.257527339 | 0.131433394 |
| 227 | A | P | 0.257425537 | 0.162403215 |
| 319 | A | A | 0.25734846 | 0.183688663 |
| 773 | R | I | 0.257312824 | 0.076585471 |
| 59 | S | R | 0.257311236 | 0.098683009 |
| 522 | G | D | 0.257141461 | 0.205906219 |
| 164 | E | D | 0.257089377 | 0.152824439 |
| 705 | QA | R- | 0.257083631 | 0.186668119 |
| 82 | H | Y | 0.256846745 | 0.145259346 |
| 606 | G | R | 0.256772211 | 0.222683526 |
| 281 | P | L | 0.256724807 | 0.103452649 |
| 471 | D | Y | 0.256649107 | 0.251689277 |
| 231 | A | S | 0.256583564 | 0.187236499 |
| 433 | K | N | 0.256518065 | 0.138408672 |
| 883 | S | G | 0.256375244 | 0.115658726 |

TABLE 6-continued

Fold enrichment of CasX DME Variants

| Pos. | Ref. | Alt. | Med. Enrich. | 95% CI |
|---|---|---|---|---|
| 672 | P | A | 0.256302042 | 0.169194225 |
| 681 | KD | R- | 0.256180855 | 0.206050883 |
| 762 | G | A | 0.256159485 | 0.149790153 |
| 774 | Q | R | 0.256113556 | 0.176872341 |
| 630 | P | T | 0.255980317 | 0.147464802 |
| 151 | H | Q | 0.255948941 | 0.118092357 |
| 38 | PDL | LT[stop] | 0.255810824 | 0.132108929 |
| 240 | LT | PV | 0.255810824 | 0.138991378 |
| 519 | — | QKDGVK (SEQ ID NO: 3747) | 0.255711118 | 0.090066635 |
| 977 | V | E | 0.255573788 | 0.223531947 |
| 448 | S | P | 0.255534334 | 0.216106849 |
| 872 | — | LSEE (SEQ ID NO: 3748) | 0.255312236 | 0.130213196 |
| 534 | -Y | DS | 0.255312236 | 0.080703663 |
| 765 | — | GK | 0.255312236 | 0.10865158 |
| 28 | MK | C- | 0.255312236 | 0.091611028 |
| 826 | EK | DR | 0.255312236 | 0.103881802 |
| 302 | I | S | 0.2552956 | 0.169641843 |
| 866 | S | I | 0.255156321 | 0.209048192 |
| 472 | K | M | 0.255025429 | 0.186702335 |
| 165 | R | S | 0.25497678 | 0.100932181 |
| 242 | K | R | 0.254948866 | 0.230748057 |
| 311 | — | KLK | 0.25494628 | 0.09906032 |
| 200 | V | E | 0.254874846 | 0.123567532 |
| 129 | C | R | 0.25474894 | 0.168215252 |
| 284 | P | A | 0.254723328 | 0.141080203 |
| 232 | — | CMG | 0.254645266 | 0.200305653 |
| 946 | N | S | 0.2545847 | 0.199844301 |
| 80 | I | V | 0.254434146 | 0.224490053 |
| 327 | G | V | 0.254442364 | 0.168129037 |
| 107 | I | V | 0.254364427 | 0.144921072 |
| 777 | R | I | 0.254281708 | 0.219559132 |
| 801 | L | P | 0.254280774 | 0.139428109 |
| 417 | Y | H | 0.254230823 | 0.102936144 |
| 251 | Q | L | 0.254085129 | 0.154282551 |
| 856 | Y | [stop] | 0.254033585 | 0.087466157 |
| 753 | I | F | 0.25397349 | 0.160875608 |
| 303 | W | G | 0.253842324 | 0.162875151 |
| 852 | Y | H | 0.253666441 | 0.130229811 |
| 223 | P | S | 0.253640033 | 0.10193396 |
| 472 | K | [stop] | 0.253606489 | 0.18360472 |
| 851 | T | S | 0.25343316 | 0.097399235 |
| 725 | K | E | 0.253359857 | 0.175271591 |
| 115 | V | L | 0.253354021 | 0.093695173 |
| 918 | T | I | 0.253156435 | 0.23080792 |
| 630 | P | L | 0.252953716 | 0.223745102 |
| 75 | E | Q | 0.252809731 | 0.120415311 |
| 480 | L | M | 0.252718021 | 0.192126204 |
| 197 | S | T | 0.252713621 | 0.125864993 |
| 779 | E | Q | 0.25259488 | 0.11277405 |
| 340 | EV | DC | 0.252472535 | 0.047624791 |
| 12 | R | K | 0.252469729 | 0.189301078 |
| 515 | A | S | 0.252433747 | 0.168422609 |
| 615 | — | VIEK (SEQ ID NO: 3749) | 0.252369421 | 0.112001396 |
| 513 | N | S | 0.252353713 | 0.094778563 |
| 274 | A | P | 0.252335379 | 0.222801897 |
| 474 | E | Q | 0.252314637 | 0.161495393 |
| 898 | K | E | 0.252289386 | 0.197783073 |
| 397 | Q | K | 0.252164481 | 0.217428232 |
| 455 | W | S | 0.25204917 | 0.248519347 |
| 135 | P | S | 0.252041319 | 0.143618662 |
| 500 | N | D | 0.252036438 | 0.129905572 |
| 204 | S | I | 0.252028425 | 0.131493678 |
| 235 | A | T | 0.251989659 | 0.158776047 |
| 839 | I | M | 0.251899392 | 0.164461403 |
| 473 | D | N | 0.251700557 | 0.215226558 |
| 715 | A | D | 0.251688144 | 0.14707302 |
| 352 | K | E | 0.251658395 | 0.165058904 |
| 423 | R | I | 0.251517421 | 0.230382833 |
| 272 | G | R | 0.251488679 | 0.185835986 |
| 647 | S | R | 0.251423405 | 0.100129809 |
| 333 | L | M | 0.251344003 | 0.196286065 |
| 964 | F | Y | 0.25104576 | 0.166483614 |
| 474 | E | K | 0.250927827 | 0.172968831 |

TABLE 6-continued

Fold enrichment of CasX DME Variants

| Pos. | Ref. | Alt. | Med. Enrich. | 95% CI |
|---|---|---|---|---|
| 751 | M | V | 0.250846737 | 0.147715329 |
| 471 | D | N | 0.250823008 | 0.230246417 |
| 714 | R | [stop] | 0.250772621 | 0.098784657 |
| 192 | A | S | 0.25063862 | 0.18266448 |
| 668 | A | D | 0.250605134 | 0.186660163 |
| 147 | — | KG | 0.250457437 | 0.166419391 |
| 464 | IE | DR | 0.250457437 | 0.129773988 |
| 325 | — | LK | 0.250457437 | 0.197198993 |
| 812 | C | R | 0.250440238 | 0.175896886 |
| 215 | G | C | 0.250425413 | 0.161826099 |
| 564 | G | D | 0.250350924 | 0.110254953 |
| 787 | A | D | 0.250325364 | 0.160958271 |
| 674 | G | V | 0.25029228 | 0.086627759 |
| 182 | T | A | 0.250160953 | 0.131790182 |
| 383 | S | R | 0.250148943 | 0.108851149 |
| 497 | E | G | 0.250036476 | 0.073841396 |
| 154 | Y | C | 0.250036476 | 0.229055007 |
| 827 | K | R | 0.250016633 | 0.209047833 |
| 722 | Y | [stop] | 0.249927847 | 0.149439604 |
| 380 | Y | H | 0.2.49902562 | 0.080398395 |
| 68 | K | [stop] | 0.249695921 | 0.134323821 |
| 178 | D | Y | 0.24960373 | 0.233005696 |
| 880 | D | V | 0.249521617 | 0.133706258 |
| 543 | K | R | 0.249512007 | 0.164262829 |
| 101 | E | E | 0.249509933 | 0.220597507 |
| 261 | L | P | 0.249467079 | 0.135680009 |
| 410 | G | A | 0.249451996 | 0.157770206 |
| 916 | — | FETHAAEQA (SEQ ID NO: 3750) | 0.249445316 | 0.231377364 |
| 467 | L | M | 0.249366626 | 0.154018589 |
| 745 | A | V | 0.249363082 | 0.18169323 |
| 773 | R | K | 0.249259705 | 0.143796066 |
| 221 | S | Y | 0.249177365 | 0.225580403 |
| 953 | DK | CL | 0.248980289 | 0.153230139 |
| 213 | — | QIGGNS (SEQ ID NO: 3751) | 0.248980289 | 0.134226006 |
| 57 | P | H | 0.248900571 | 0.215896368 |
| 301 | V | L | 0.24886944 | 0.106508651 |
| 586 | A | P | 0.248863678 | 0.211216154 |
| 909 | F | Y | 0.248749713 | 0.182356511 |
| 626 | R | T | 0.248743703 | 0.208846467 |
| 186 | G | R | 0.24871786 | 0.199871451 |
| 645 | D | N | 0.248657263 | 0.126033155 |
| 173 | K | R | 0.24855018 | 0.153000538 |
| 519 | Q | [stop] | 0.248535487 | 0.209163595 |
| 888 | R | I | 0.248471987 | 0.104169936 |
| 491 | G | C | 0.248444417 | 0.204717262 |
| 527 | N | K | 0.248397784 | 0.121054149 |
| 893 | L | V | 0.248370955 | 0.162725859 |
| 379 | P | H | 0.248321642 | 0.237522233 |
| 900 | F | L | 0.248316685 | 0.187112489 |
| 974 | — | KPAV (SEQ ID NO: 3752)[stop] | 0.24830974 | 0.09950399 |
| 409 | H | R | 0.248289463 | 0.198716638 |
| 278 | I | T | 0.248133293 | 0.145997719 |
| 230 | — | DACMG (SEQ ID NO: 3753) | 0.248087937 | 0.141736439 |
| 412 | — | DWGKVY (SEQ ID NO: 3754) | 0.248000785 | 0.085936492 |
| 135 | P | H | 0.247697198 | 0.24068468 |
| 824 | V | E | 0.247676063 | 0.211426874 |
| 250 | H | N | 0.247644364 | 0.173527273 |
| 101 | Q | [stop] | 0.247598429 | 0.141658982 |
| 364 | F | S | 0.247520151 | 0.139448351 |
| 420 | A | G | 0.247498728 | 0.234162787 |
| 29 | KT | NC | 0.247444507 | 0.126896702 |
| 777 | R | G | 0.247073817 | 0.140696212 |
| 720 | R | T | 0.246870637 | 0.139065914 |
| 529 | — | YLI | 0.246804685 | 0.066320143 |
| 977 | V | M | 0.24675063 | 0.232768749 |
| 414 | G | C | 0.246666689 | 0.173156358 |
| 487 | G | D | 0.246317089 | 0.205561043 |
| 696 | S | G | 0.246296346 | 0.111834798 |
| 515 | A | G | 0.246293045 | 0.17108612 |
| 438 | — | EE | 0.246243471 | 0.172505379 |
| 730 | A | S | 0.246013083 | 0.141113967 |

TABLE 6-continued

Fold enrichment of CasX DME Variants

| Pos. | Ref. | Alt. | Med. Enrich. | 95% CI |
|---|---|---|---|---|
| 574 | N | D | 0.245981475 | 0.227302881 |
| 747 | T | S | 0.245965899 | 0.17316365 |
| 740 | D | Y | 0.245945789 | 0.167910919 |
| 640 | R | I | 0.245900817 | 0.188813199 |
| 3 | I | F | 0.245678 | 0.179390362 |
| 355 | N | D | 0.245670687 | 0.09594124 |
| 371 | Y | [stop] | 0.245500092 | 0.105713424 |
| 51 | P | S | 0.244544462 | 0.203086773 |
| 28 | M | L | 0.245403036 | 0.189135882 |
| 458 | A | D | 0.245377197 | 0.208634207 |
| 572 | N | I | 0.24524576 | 0.164550203 |
| 959 | E | [stop] | 0.245144817 | 0.219795779 |
| 527 | N | S | 0.245098015 | 0.16437657 |
| 321 | P | S | 0.245086017 | 0.160736605 |
| 579 | N | K | 0.244981546 | 0.165374413 |
| 707 | A | P | 0.244857358 | 0.22019856 |
| 414 | G | A | 0.244717702 | 0.113316145 |
| 548 | E | V | 0.244464905 | 0.11615159 |
| 963 | S | G | 0.244450471 | 0.188301401 |
| 108 | D | H | 0.244382837 | 0.099322593 |
| 19 | T | R | 0.244301214 | 0.22638105 |
| 457 | R | S | 0.244059876 | 0.203207391 |
| 735 | R | Q | 0.243928198 | 0.170841115 |
| 280 | L | P | 0.243719915 | 0.122012762 |
| 627 | Q | P | 0.243601279 | 0.172067752 |
| 571 | — | VN | 0.243561744 | 0.078796567 |
| 25 | T | A | 0.243399906 | 0.118102255 |
| 129 | C | S | 0.243399597 | 0.045331126 |
| 522 | G | S | 0.243323907 | 0.089702225 |
| 695 | P | K | 0.243320032 | 0.148139423 |
| 603 | L | V | 0.243217969 | 0.148743728 |
| 404 | H | Q | 0.242964457 | 0.173626579 |
| 469 | E | Q | 0.242802772 | 0.126770274 |
| 484 | KWY | NSS | 0.242735572 | 0.182387025 |
| 797 | L | V | 0.2425558 | 0.204091719 |
| 928 | I | F | 0.242416049 | 0.232458614 |
| 974 | K | R | 0.242320513 | 0.114367362 |
| 687 | P | L | 0.242304633 | 0.20007901 |
| 885 | T | R | 0.242245862 | 0.204992576 |
| 768 | T | S | 0.242193729 | 0.178836886 |
| 588 | — | GKRQ (SEQ ID NO: 3755) | 0.242084293 | 0.124769338 |
| 262 | — | ANLKDI (SEQ ID NO: 3756) | 0.242084293 | 0.137081914 |
| 246 | I | C | 0.242084293 | 0.107590717 |
| 288 | E | [stop] | 0.242056668 | 0.219648186 |
| 978 | -[stop] | YV | 0.242009218 | 0.097706533 |
| 110 | R | [stop] | 0.241965346 | 0.120709959 |
| 741 | L | M | 0.241912289 | 0.193137515 |
| 72 | D | Y | 0.241758248 | 0.224435844 |
| 653 | N | Y | 0.24166971 | 0.0887834 |
| 324 | R | [stop] | 0.241651421 | 0.106997792 |
| 293 | Y | D | 0.241440886 | 0.202068751 |
| 695 | E | A | 0.241330438 | 0.115436697 |
| 798 | — | SKTLAQYT (SEQ ID NO: 3757) | 0.241309883 | 0.196326087 |
| 866 | S | G | 0.241237257 | 0.109329768 |
| 529 | V | C | 0.241113191 | 0.148105236 |
| 102 | P | S | 0.241100901 | 0.126616893 |
| 568 | P | R | 0.241086845 | 0.174639843 |
| 416 | V | L | 0.24098406 | 0.086334529 |
| 834 | G | S | 0.240965197 | 0.161966438 |
| 322 | L | M | 0.240965197 | 0.161073617 |
| 538 | G | S | 0.2.40933783 | 0.072861862 |
| 536 | K | E | 0.240888218 | 0.130971778 |
| 676 | P | S | 0.240757682 | 0.111329254 |
| 108 | D | E | 0.240718917 | 0.12602791 |
| 217 | N | K | 0.240713475 | 0.15867648 |
| 342 | D | E | 0.24062135 | 0.069616641 |
| 471 | D | H | 0.240564636 | 0.181535186 |
| 218 | S | N | 0.240529528 | 0.151826239 |
| 191 | R | I | 0.240513696 | 0.229207246 |
| 963 | — | SFY | 0.240421887 | 0.098315268 |
| 77 | K | N | 0.240381155 | 0.116252284 |
| 637 | — | TFER (SEQ ID NO: 3758) | 0.240288787 | 0.148900082 |

TABLE 6-continued

Fold enrichment of CasX DME Variants

| Pos. | Ref. | Alt. | Med. Enrich. | 95% CI |
|---|---|---|---|---|
| 571 | V | L | 0.240279118 | 0.074639743 |
| 346 | M | T | 0.240147015 | 0.108146398 |
| 512 | Y | [stop] | 0.240104852 | 0.068415116 |
| 430 | G | C | 0.240047705 | 0.20806366 |
| 599 | D | G | 0.239869359 | 0.206138755 |
| 462 | F | S | 0.23971457 | 0.144092402 |
| 724 | S | R | 0.239681347 | 0.127922837 |
| 61 | T | S | 0.239626948 | 0.164373644 |
| 525 | K | [stop] | 0.239380142 | 0.131802154 |
| 296 | V | E | 0.239355864 | 0.120748179 |
| 968 | K | Q | 0.238999998 | 0.129755167 |
| 617 | E | K | 0.238964823 | 0.084548152 |
| 120 | E | K | 0.238945442 | 0.100801456 |
| 44 | L | V | 0.238860984 | 0.10949901 |
| 315 | G | R | 0.238751925 | 0.215543005 |
| 87 | E | [stop] | 0.238731064 | 0.177299521 |
| 818 | S | G | 0.238509249 | 0.201919192 |
| 189 | G | V | 0.238447609 | 0.179422249 |
| 394 | A | D | 0.238439863 | 0.125867824 |
| 861 | — | V | 0.238439176 | 0.202222792 |
| 357 | K | E | 0.238434177 | 0.184905545 |
| 353 | L | V | 0.23831895 | 0.17206072 |
| 488 | D | V | 0.2382354 | 0.188903119 |
| 684 | — | LGNPT (SEQ ID NO: 3759) | 0.2382268 | 0.157487774 |
| 376 | A | V | 0.238191318 | 0.142572457 |
| 349 | N | D | 0.238174065 | 0.053089179 |
| 331 | F | S | 0.238131141 | 0.093269792 |
| 971 | E | D | 0.238076025 | 0.194709418 |
| 775 | Y | F | 0.238057448 | 0.214475137 |
| 730 | A | I | 0.238038323 | 0.175731569 |
| 631 | — | ALF | 0.237949975 | 0.190053084 |
| 504 | D | H | 0.23794567 | 0.139048842 |
| 94 | G | D | 0.237937578 | 0.15570335 |
| 291 | E | [stop] | 0.237828954 | 0.19900832 |
| 871 | R | I | 0.237759309 | 0.236033629 |
| 761 | F | V | 0.237669703 | 0.128380283 |
| 910 | — | VCLN (SEQ ID NO: 3760) | 0.237633429 | 0.152561858 |
| 731 | D | Y | 0.237566392 | 0.167223625 |
| 245 | D | A | 0.237553897 | 0.189220496 |
| 979 | L-E | VWS | 0.237546222 | 0.150693183 |
| 208 | V | E | 0.237546113 | 0.17752812 |
| 483 | Q | R | 0.23746372 | 0.159123209 |
| 634 | V | M | 0.237398857 | 0.152995502 |
| 837 | T | I | 0.237183554 | 0.104666535 |
| 479 | E | Q | 0.237085358 | 0.157162064 |
| 555 | F | V | 0.237065318 | 0.182110462 |
| 872 | LS | PV | 0.23698628 | 0.179042308 |
| 601 | L | P | 0.236954247 | 0.122470012 |
| 127 | F | L | 0.236892252 | 0.129435749 |
| 204 | S | C | 0.236855446 | 0.164372504 |
| 82 | H | Q | 0.236837713 | 0.172606609 |
| 861 | — | VVKDLSVE (SEQ ID NO: 3761) | 0.236770505 | 0.195127344 |
| 493 | P | L | 0.236700832 | 0.181806123 |
| 474 | E | G | 0.236695789 | 0.180206764 |
| 302 | I | F | 0.236588615 | 0.136160472 |
| 109 | Q | R | 0.236576305 | 0.166840659 |
| 97 | S | R | 0.236508024 | 0.179878709 |
| 40 | L | V | 0.236210141 | 0.21459356 |
| 761 | F | C | 0.236145536 | 0.170046245 |
| 50 | K | N | 0.236137845 | 0.22219675 |
| 205 | N | K | 0.236073257 | 0.12180008 |
| 399 | G | D | 0.236045787 | 0.181873656 |
| 521 | S | Y | 0.235934057 | 0.180076567 |
| 665 | A | D | 0.235822456 | 0.220273467 |
| 252 | K | R | 0.235675801 | 0.120466673 |
| 646 | S | R | 0.235675637 | 0.183914638 |
| 102 | P | A | 0.235653058 | 0.16760539 |
| 810 | S | N | 0.235539825 | 0.164257896 |
| 936 | R | S | 0.235496123 | 0.188093786 |
| 111 | K | R | 0.235492778 | 0.118354865 |
| 220 | A | V | 0.235467868 | 0.198253635 |
| 855 | — | RYK | 0.235222552 | 0.156668306 |
| 354 | I | N | 0.235178848 | 0.098023234 |

TABLE 6-continued

| Fold enrichment of CasX DME Variants | | | | |
|---|---|---|---|---|
| Pos. | Ref. | Alt. | Med. Enrich. | 95% CI |
| 158 | C | F | 0.235135625 | 0.169427052 |
| 689 | H | R | 0.235102048 | 0.220671524 |
| 594 | E-F | GRII (SEQ ID NO: 3762) | 0.235051862 | 0.132444365 |
| 154 | Y | D | 0.234980588 | 0.232501764 |
| 870 | D | V | 0.234951394 | 0.118777361 |
| 198 | I | N | 0.234906329 | 0.184047389 |
| 76 | M | I | 0.234796263 | 0.126238567 |
| 434 | H | N | 0.234726089 | 0.143174214 |
| 484 | -KW | NSSL (SEQ ID NO: 3763) | 0.234680329 | 0.165662856 |
| 49 | K | [stop] | 0.234415257 | 0.114263318 |
| 896 | L | P | 0.234287413 | 0.192149813 |
| 530 | L | V | 0.234192802 | 0.173965176 |
| 643 | V | A | 0.234106948 | 0.176627185 |
| 711 | E | K | 0.234002178 | 0.154011045 |
| 918 | — | THAAEQ (SEQ ID NO: 3764) | 0.23373891 | 0.117744474 |
| 473 | D | E | 0.233630727 | 0.181285916 |
| 666 | V | E | 0.233615017 | 0.210063502 |
| 610 | — | LANGRVIE (SEQ ID NO: 3765) | 0.233598549 | 0.098900798 |
| 463 | V | A | 0.233582437 | 0.13705941 |
| 771 | A | V | 0.233335501 | 0.144017771 |
| 89 | Q | H | 0.233314663 | 0.120225936 |
| 18 | N | D | 0.233234266 | 0.100130745 |
| 547 | P | A | 0.233232691 | 0.192665943 |
| 628 | D | H | 0.233191566 | 0.113338873 |
| 290 | I | V | 0.233178351 | 0.147527858 |
| 837 | — | TTIN (SEQ ID NO: 3766) | 0.233038063 | 0.141130326 |
| 909 | — | FV | 0.233038063 | 0.131142006 |
| 260 | R | G | 0.232970656 | 0.120191772 |
| 707 | — | AKEVEQR (SEQ ID NO: 3767) | 0.232896265 | 0.116012039 |
| 638 | F | S | 0.232893598 | 0.149395863 |
| 671 | D | A | 0.232880356 | 0.163658679 |
| 443 | S | T | 0.232784832 | 0.170920909 |
| 392 | K | N | 0.232687633 | 0.108105318 |
| 500 | N | I | 0.232640715 | 0.1305158 |
| 111 | K | E | 0.232613623 | 0.097737029 |
| 570 | E | Q | 0.232497705 | 0.099759258 |
| 645 | D | E | 0.2323596 | 0.127143455 |
| 54 | I | N | 0.23228755 | 0.182788712 |
| 725 | K | R | 0.232253631 | 0.11253677 |
| 771 | A | S | 0.232158252 | 0.16845905 |
| 896 | L | V | 0.232108864 | 0.141878039 |
| 487 | G | V | 0.232053935 | 0.22651513 |
| 655 | I | V | 0.231994505 | 0.148078533 |
| 708 | K | R | 0.231988811 | 0.183732743 |
| 699 | E | D | 0.231934703 | 0.178386576 |
| 446 | A | P | 0.231896096 | 0.131534649 |
| 902 | H | P | 0.231793863 | 0.226418313 |
| 555 | F | S | 0.231772683 | 0.154329003 |
| 685 | G | R | 0.231646911 | 0.113490558 |
| 430 | G | A | 0.231581897 | 0.168869877 |
| 423 | R | G | 0.231294589 | 0.188648387 |
| 773 | R | S | 0.231238362 | 0.139470334 |
| 148 | — | GKP | 0.231166477 | 0.084708483 |
| 795 | TY | PG | 0.231166477 | 0.229360354 |
| 598 | N | S | 0.230890539 | 0.114382772 |
| 109 | Q | [stop] | 0.230738213 | 0.089332392 |
| 481 | — | KLQK (SEQ ID NO: 3768) | 0.23071553 | 0.20441951 |
| 592 | -GR | DNQ | 0.230655892 | 0.071944702 |
| 254 | I | T | 0.2306357 | 0.069580284 |
| 530 | L | R | 0.230571343 | 0.193066361 |
| 365 | W | [stop] | 0.230333383 | 0.12753339 |
| 131 | Q | R | 0.2302555 | 0.206903114 |
| 244 | Q | E | 0.230190451 | 0.222512927 |
| 900 | F | I | 0.230181139 | 0.149890666 |
| 318 | E | Q | 0.230160478 | 0.212890421 |
| 312 | L | M | 0.230110955 | 0.204915228 |
| 106 | N | S | 0.230101564 | 0.155287559 |
| 968 | K | R | 0.230017803 | 0.168949701 |
| 631 | A | P | 0.229723383 | 0.159718894 |

TABLE 6-continued

Fold enrichment of CasX DME Variants

| Pos. | Ref. | Alt. | Med. Enrich. | 95% CI |
|---|---|---|---|---|
| 610 | L | V | 0.229644521 | 0.180175813 |
| 847 | E | G | 0.229640073 | 0.111868196 |
| 636 | — | LT | 0.229485665 | 0.192188426 |
| 665 | A | G | 0.229408129 | 0.212381399 |
| 82 | H | R | 0.229295108 | 0.108155794 |
| 371 | Y | D | 0.229277426 | 0.117283148 |
| 148 | G | V | 0.229238098 | 0.159823444 |
| 443 | S | I | 0.229142738 | 0.169822985 |
| 660 | G | C | 0.229029418 | 0.194710612 |
| 181 | V | D | 0.228966959 | 0.164951106 |
| 832 | A | P | 0.228767879 | 0.092204547 |
| 152 | I | A | 0.228705386 | 0.182569685 |
| 685 | G | A | 0.228675631 | 0.17392363 |
| 112 | L | P | 0.22866263 | 0.221195984 |
| 214 | I | T | 0.22857342 | 0.11423526 |
| 610 | L | M | 0.22841473 | 0.205382368 |
| 110 | R | G | 0.228257249 | 0.086720324 |
| 590 | R | S | 0.228041456 | 0.143022556 |
| 596 | I | M | 0.227907909 | 0.117874099 |
| 1 | Q | P | 0.227785203 | 0.168369144 |
| 567 | V | E | 0.227660557 | 0.156302233 |
| 32 | L | V | 0.227635279 | 0.12966479 |
| 65 | N | S | 0.22749218 | 0.063907676 |
| 291 | E | G | 0.227296993 | 0.128103388 |
| 635 | A | V | 0.22713711 | 0.159876533 |
| 894 | S | I | 0.227093532 | 0.165363718 |
| 675 | C | R | 0.227077437 | 0.19145584 |
| 863 | K | E | 0.227027728 | 0.176903569 |
| 130 | S | N | 0.226933191 | 0.162445952 |
| 187 | K | E | 0.226883263 | 0.185467572 |
| 330 | S | G | 0.226753105 | 0.138020012 |
| 224 | V | A | 0.226536103 | 0.153342124 |
| 802 | A | I | 0.226368502 | 0.154358709 |
| 148 | G | S | 0.226168476 | 0.097680006 |
| 732 | D | E | 0.226134547 | 0.109002487 |
| 864 | D | G | 0.226094276 | 0.177950676 |
| 140 | K | R | 0.226067524 | 0.114127554 |
| 814 | F | S | 0.225959256 | 0.114511043 |
| 215 | G | D | 0.225350951 | 0.086324983 |
| 138 | V | L | 0.225143743 | 0.155359682 |
| 192 | A | T | 0.22512485 | 0.144695235 |
| 502 | I | S | 0.225038868 | 0.197567126 |
| 494 | F | V | 0.224968248 | 0.143764694 |
| 162 | E | D | 0.224950043 | 0.153078143 |
| 788 | Y | [stop] | 0.22492674 | 0.129943744 |
| 263 | N | I | 0.22.4722541 | 0.117014395 |
| 918 | — | THAAEQA (SEQ ID NO: 3769) | 0.224719714 | 0.202778103 |
| 272 | G | A | 0.224696933 | 0.211543463 |
| 322 | L | V | 0.22.46772 | 0.156881144 |
| 132 | C | R | 0.224659007 | 0.146010501 |
| 657 | I | F | 0.224649177 | 0.161870244 |
| 917 | — | E | 0.224592553 | 0.150266826 |
| 704 | — | IQAAKE (SEQ ID NO: 3770) | 0.224567514 | 0.109443666 |
| 328 | — | FPS | 0.224567514 | 0.088644166 |
| 455 | W | R | 0.224240948 | 0.159412878 |
| 528 | — | LY | 0.224210461 | 0.204469226 |
| 289 | G | A | 0.224158556 | 0.07475664 |
| 477 | RCE | SFS | 0.224109734 | 0.175971589 |
| 290 | I | M | 0.224106784 | 0.121750806 |
| 699 | EK | AV | 0.223971566 | 0.120407858 |
| 190 | — | QRALDFY (SEQ ID NO: 3771) | 0.223971566 | 0.118248938 |
| 287 | K | [stop] | 0.223966216 | 0.119362605 |
| 33 | V | A | 0.223884337 | 0.200194354 |
| 321 | P | R | 0.223833871 | 0.153353055 |
| 350 | V | L | 0.223803585 | 0.123552417 |
| 598 | N | D | 0.223755594 | 0.127015451 |
| 784 | A | V | 0.22374846 | 0.140061096 |
| 540 | L | P | 0.223660834 | 0.130300184 |
| 330 | S | R | 0.2236138 | 0.142019721 |
| 162 | E | Q | 0.223613045 | 0.201165398 |
| 128 | A | V | 0.223401934 | 0.126557909 |
| 296 | V | L | 0.223401818 | 0.13392173 |
| 634 | V | E | 0.223309652 | 0.118175475 |

TABLE 6-continued

Fold enrichment of CasX DME Variants

| Pos. | Ref. | Alt. | Med. Enrich. | 95% CI |
|---|---|---|---|---|
| 356 | E | Q | 0.22323735 | 0.143945409 |
| 289 | G | V | 0.223202197 | 0.145913012 |
| 805 | T | N | 0.223188037 | 0.139245678 |
| 599 | D | Y | 0.223008187 | 0.183323322 |
| 246 | I | M | 0.222998811 | 0.092368092 |
| 36 | M | K | 0.222893666 | 0.113406903 |
| 476 | C | [stop] | 0.222743024 | 0.176188321 |
| 464 | I | V | 0.222701858 | 0.18421718 |
| 224 | V | L | 0.222626458 | 0.136476862 |
| 42 | E | G | 0.22255062 | 0.189996134 |
| 832 | A | S | 0.222538216 | 0.190249328 |
| 734 | V | I | 0.222476682 | 0.141366416 |
| 146 | D | H | 0.22246095 | 0.16577062 |
| 755 | AN | DS | 0.222404547 | 0.10970681 |
| 581 | I | V | 0.222357666 | 0.17105795 |
| 698 | K | [stop] | 0.222296953 | 0.103211977 |
| 507 | G | D | 0.22225927 | 0.153400026 |
| 246 | I | V | 0.222098073 | 0.120973819 |
| 47 | L | P | 0.222066189 | 0.162841956 |
| 301 | VI | CL | 0.222059585 | 0.122617461 |
| 210 | PL | DR | 0.222059585 | 0.108090576 |
| 174 | — | PEANDE (SEQ ID NO: 3772) | 0.222059585 | 0.182232379 |
| 160 | — | VSE | 0.222059585 | 0.137662445 |
| 68 | K | E | 0.222044865 | 0.16348242 |
| 119 | K | [stop] | 0.221989288 | 0.160692576 |
| 230 | — | DAC | 0.221929991 | 0.119956442 |
| 559 | -I | TV | 0.221929991 | 0.162385076 |
| 125 | S | T | 0.221924231 | 0.192354491 |
| 738 | A | P | 0.221764129 | 0.166374434 |
| 389 | K | L | 0.221512528 | 0.096823472 |
| 829 | K | M | 0.22130603 | 0.111760034 |
| 435 | I | V | 0.221227154 | 0.143247597 |
| 626 | R | S | 0.221038435 | 0.198631408 |
| 135 | P | R | 0.221017429 | 0.116069626 |
| 203 | E | Q | 0.22076143 | 0.119826394 |
| 783 | T | I | 0.220740744 | 0.134860122 |
| 672 | P | S | 0.220729114 | 0.141569742 |
| 361 | G | D | 0.220639166 | 0.141910298 |
| 690 | I | M | 0.220631897 | 0.180897111 |
| 552 | A | G | 0.220614882 | 0.110523427 |
| 441 | R | I | 0.220543521 | 0.155159451 |
| 218 | S | R | 0.220420945 | 0.153071166 |
| 917 | — | ETHAAE (SEQ ID NO: 3773) | 0.220288736 | 0.09840913 |
| 204 | S | R | 0.220214876 | 0.101819626 |
| 255 | K | E | 0.220080844 | 0.12573371 |
| 479 | E | D | 0.220079089 | 0.099777598 |
| 438 | E | G | 0.219979549 | 0.120742867 |
| 605 | T | I | 0.219976898 | 0.126979027 |
| 109 | Q | E | 0.219959218 | 0.140761458 |
| 744 | Y | C | 0.219956045 | 0.132833086 |
| 930 | — | RSWLFL (SEQ ID NO: 3774) | 0.219822658 | 0.120132898 |
| 172 | H | Q | 0.219757029 | 0.10461302 |
| 329 | P | A | 0.219753668 | 0.110968401 |
| 783 | T | S | 0.219504994 | 0.118049041 |
| 610 | L | P | 0.219499239 | 0.160199117 |
| 38 | P | A | 0.219404694 | 0.107368636 |
| 446 | A | V | 0.218887024 | 0.176662627 |
| 41 | R | K | 0.218858764 | 0.128896181 |
| 810 | S | R | 0.21870856 | 0.129689435 |
| 83 | V | L | 0.218625171 | 0.138945755 |
| 474 | E | D | 0.218570822 | 0.130400355 |
| 712 | Q | [stop] | 0.218254094 | 0.091444311 |
| 371 | V | H | 0.218137961 | 0.189187449 |
| 35 | V | L | 0.218110612 | 0.095949997 |
| 687 | P | R | 0.21806458 | 0.159278352 |
| 621 | Y | N | 0.218036238 | 0.089590425 |
| 753 | I | N | 0.21792347 | 0.101271232 |
| 337 | Q | L | 0.217694196 | 0.180223104 |
| 366 | Q | E | 0.217564323 | 0.195945495 |
| 156 | G | R | 0.217510036 | 0.186872459 |
| 813 | G | A | 0.217404463 | 0.109971024 |
| 911 | C | W | 0.217360044 | 0.181625646 |
| 896 | L | Q | 0.217312492 | 0.09770592 |

TABLE 6-continued

Fold enrichment of CasX DME Variants

| Pos. | Ref. | Alt. | Med. Enrich. | 95% CI |
|---|---|---|---|---|
| 395 | R | S | 0.217267056 | 0.103436045 |
| 506 | S | R | 0.217238346 | 0.104753923 |
| 459 | KA | NR | 0.217171538 | 0.126085081 |
| 605 | T | S | 0.217140582 | 0.104288213 |
| 147 | K | R | 0.217113942 | 0.165662771 |
| 358 | K | R | 0.217018444 | 0.148484962 |
| 710 | V | E | 0.216906218 | 0.158321115 |
| 948 | T | N | 0.216794988 | 0.204294035 |
| 62 | S | T | 0.216604466 | 0.167204921 |
| 827 | K | E | 0.216603742 | 0.107241416 |
| 457 | R | G | 0.216513116 | 0.052626339 |
| 159 | N | K | 0.216507269 | 0.109954163 |
| 177 | N | D | 0.216431319 | 0.179290406 |
| 921 | — | AEQAALN (SEQ ID NO: 3776) | 0.216389396 | 0.149922966 |
| 633 | — | FV | 0.216309574 | 0.179645361 |
| 433 | — | KHI | 0.216309574 | 0.092546366 |
| 375 | E | [stop] | 0.216261145 | 0.199757211 |
| 297 | V | A | 0.216143366 | 0.15509483 |
| 148 | — | GKPHTNYF (SEQ ID NO: 3777) | 0.216132461 | 0.211503255 |
| 645 | D | V | 0.21604012 | 0.117781298 |
| 147 | KG | R- | 0.215998635 | 0.103939398 |
| 292 | A | S | 0.215943856 | 0.157240024 |
| 387 | R | G | 0.215798372 | 0.151215331 |
| 157 | R | T | 0.215790548 | 0.152247144 |
| 203 | E | K | 0.215703649 | 0.168783031 |
| 123 | T | S | 0.21570133 | 0.105624839 |
| 383 | S | G | 0.215603433 | 0.137401501 |
| 310 | Q | [stop] | 0.21551735 | 0.135329921 |
| 592 | G | A | 0.215456343 | 0.13373272 |
| 562 | K | R | 0.215325036 | 0.122831356 |
| 951 | N | S | 0.21531813 | 0.214926405 |
| 823 | R | I | 0.215273573 | 0.191310901 |
| 723 | A | P | 0.215193332 | 0.108699964 |
| 713 | R | T | 0.215008884 | 0.104394548 |
| 878 | N | I | 0.214931515 | 0.11752804 |
| 145 | N | H | 0.214892161 | 0.185408691 |
| 338 | A | T | 0.21480521 | 0.15310635 |
| 169 | L | V | 0.214751891 | 0.163877193 |
| 30 | T | P | 0.214714414 | 0.144104489 |
| 164 | E | A | 0.214693055 | 0.151150991 |
| 734 | V | F | 0.214507965 | 0.184315198 |
| 841 | G | V | 0.21449654 | 0.163419397 |
| 848 | G | D | 0.214491489 | 0.166744246 |
| 93 | VGL | WA[stop] | 0.21434042 | 0.171341302 |
| 747 | T | K | 0.214238165 | 0.122971462 |
| 688 | T | K | 0.214222211 | 0.126368648 |
| 878 | N | Y | 0.214205323 | 0.111547616 |
| 190 | Q | E | 0.214170881 | 0.122424442 |
| 523 | — | VKKLN (SEQ ID NO: 3778) | 0.214126014 | 0.14801882 |
| 792 | — | PSK | 0.214126014 | 0.088425611 |
| 171 | — | PHK | 0.214126014 | 0.186440571 |
| 918 | — | TH | 0.214126014 | 0.10224323 |
| 833 | T | S | 0.214086868 | 0.0993742 |
| 72 | D | E | 0.214062412 | 0.115630034 |
| 560 | N | K | 0.213945541 | 0.173784949 |
| 906 | Q | L | 0.213845132 | 0.187470303 |
| 461 | S | I | 0.21384342 | 0.180386801 |
| 622 | N | I | 0.213809938 | 0.161761781 |
| 768 | T | I | 0.213809607 | 0.08102538 |
| 204 | — | SNH | 0.21345676 | 0.114570097 |
| 944 | — | Q | 0.213449244 | 0.157411492 |
| 49 | K | R | 0.213334728 | 0.181645679 |
| 411 | E | [stop] | 0.213222053 | 0.149931485 |
| 719 | S | A | 0.213134782 | 0.140566151 |
| 731 | D | E | 0.213022905 | 0.120709041 |
| 475 | F | S | 0.213010505 | 0.137035236 |
| 305 | N | K | 0.213008678 | 0.108878566 |
| 30 | TL | PC | 0.212945774 | 0.075648365 |
| 611 | A | G | 0.212935031 | 0.195766935 |
| 266 | DI | AV | 0.212926287 | 0.127744646 |
| 730 | — | ADDM (SEQ ID NO: 3779) | 0.212926287 | 0.097551919 |

TABLE 6-continued

Fold enrichment of CasX DME Variants

| Pos. | Ref. | Alt. | Med. Enrich. | 95% CI |
|---|---|---|---|---|
| 684 | — | LG | 0.212926287 | 0.093015719 |
| 979 | LE[stop]GSPG (SEQ ID NO: 3668) | VSSKDLK (SEQ ID NO: 3780) | 0.212926287 | 0.091900005 |
| 241 | — | TKYQ (SEQ ID NO: 3781) | 0.212926287 | 0.1464038 |
| 949 | I | I | 0.212862846 | 0.194719268 |
| 709 | E | G | 0.212846074 | 0.116849712 |
| 926 | — | LN | 0.212734596 | 0.151263965 |
| 901 | — | SHRPVQE (SEQ ID NO: 3782) | 0.212684828 | 0.084903934 |
| 459 | K | E | 0.212680715 | 0.093525423 |
| 228 | L | V | 0.212591965 | 0.092947468 |
| 831 | T | I | 0.212576099 | 0.16705965 |
| 819 | A | T | 0.212522918 | 0.164976137 |
| 645 | D | G | 0.21251225 | 0.121902674 |
| 794 | K | R | 0.212502396 | 0.178916123 |
| 859 | Q | P | 0.212311083 | 0.170329714 |
| 738 | A | G | 0.212248976 | 0.161293316 |
| 409 | H | Q | 0.212187222 | 0.201696134 |
| 192 | — | ALDFY (SEQ ID NO: 3783) | 0.212165997 | 0.132724298 |
| 782 | — | LTAKLA (SEQ ID NO: 3784) | 0.212165997 | 0.121732843 |
| 86 | EEF | DCL | 0.212165997 | 0.090389548 |
| 251 | Q | H | 0.212109948 | 0.151365816 |
| 197 | S | R | 0.211641987 | 0.087103971 |
| 196 | Y | C | 0.211596178 | 0.195825393 |
| 125 | S | I | 0.211507893 | 0.117116373 |
| 237 | A | T | 0.211485023 | 0.118730598 |
| 574 | N | S | 0.211257767 | 0.135650502 |
| 73 | Y | C | 0.211200986 | 0.169366394 |
| 380 | Y | [stop] | 0.21093329 | 0.132735624 |
| 219 | C | Y | 0.210905605 | 0.190298454 |
| 777 | R | S | 0.210879382 | 0.15535129 |
| 799 | — | KTLAQYT (SEQ ID NO: 3785) | 0.210719207 | 0.130227708 |
| 79 | A | T | 0.210637972 | 0.047863719 |
| 654 | L | R | 0.210450467 | 0.143325776 |
| 179 | E | K | 0.210277517 | 0.147945245 |
| 587 | F | E | 0.210211385 | 0.204490333 |
| 414 | E | Q | 0.210197326 | 0.171958109 |
| 546 | K | Q | 0.210196739 | 0.176398222 |
| 645 | D | Y | 0.210085231 | 0.190055155 |
| 67 | N | S | 0.210019556 | 0.1.3100266 |
| 403 | L | P | 0.209919624 | 0.075615563 |
| 452 | L | P | 0.209882094 | 0.127675947 |
| 733 | M | V | 0.209851123 | 0.136163056 |
| 872 | L | P | 0.209831548 | 0.152338232 |
| 882 | S | R | 0.209789855 | 0.108285285 |
| 679 | R | T | 0.209762925 | 0.169692137 |
| 553 | — | NRFYTVI (SEQ ID NO: 3786) | 0.209733011 | 0.13607198 |
| 650 | — | KPMN (SEQ ID NO: 3787) | 0.209706804 | 0.099600175 |
| 802 | AQ | DR | 0.209706804 | 0.100831295 |
| 415 | K | R | 0.209696722 | 0.172211853 |
| 470 | A | P | 0.209480997 | 0.11945606 |
| 389 | K | R | 0.209459216 | 0.190864781 |
| 233 | M | K | 0.209263613 | 0.148910419 |
| 846 | V | A | 0.209194154 | 0.132301095 |
| 803 | Q | R | 0.209112961 | 0.157007924 |
| 594 | -EF | GRI | 0.209067243 | 0.142920346 |
| 418 | D | Y | 0.208952621 | 0.201914561 |
| 424 | I | N | 0.208940616 | 0.184257414 |
| 152 | — | TNYFG (SEQ ID NO: 3788) | 0.208921679 | 0.069015043 |
| 184 | — | SLGKFGQ (SEQ ID NO: 3789) | 0.208921679 | 0.145515626 |
| 944 | — | QTNK (SEQ ID NO: 3790) | 0.208921679 | 0.115799997 |
| 435 | IK | DR | 0.208921679 | 0.100379476 |
| 926 | LN | PV | 0.208921679 | 0.122257143 |
| 31 | L | P | 0.208720548 | 0.120146815 |
| 595 | F | I | 0.208631842 | 0.129889087 |
| 765 | G | R | 0.208575469 | 0.10091353 |

TABLE 6-continued

Fold enrichment of CasX DME Variants

| Pos. | Ref. | Alt. | Med. Enrich. | 95% CI |
|---|---|---|---|---|
| 506 | S | G | 0.208540925 | 0.155512988 |
| 408 | K | R | 0.208534867 | 0.133392724 |
| 171 | P | A | 0.208511912 | 0.145333852 |
| 953 | — | DK | 0.208375969 | 0.185478366 |
| 518 | W | C | 0.208374964 | 0.121746678 |
| 34 | R | G | 0.208371871 | 0.100655798 |
| 663 | — | IPAV (SEQ ID NO: 3791) | 0.208314284 | 0.125213293 |
| 737 | T | S | 0.208225559 | 0.129504354 |
| 6 | I | N | 0.208110644 | 0.078448603 |
| 677 | L | M | 0.208075234 | 0.142372791 |
| 456 | L | Q | 0.208040599 | 0.142959764 |
| 190 | Q | R | 0.207948331 | 0.189816674 |
| 382 | S | G | 0.207889255 | 0.137324724 |
| 953 | D | H | 0.207762178 | 0.180457041 |
| 522 | G | R | 0.207711735 | 0.201735272 |
| 655 | I | F | 0.207554053 | 0.114186846 |
| 345 | D | N | 0.207459671 | 0.194429167 |
| 619 | T | A | 0.20742287 | 0.107807162 |
| 273 | L | M | 0.207369167 | 0.150911133 |
| 695 | E | G | 0.207324806 | 0.170023455 |
| 662 | N | S | 0.207198335 | 0.146245893 |
| 102 | P | R | 0.207103872 | 0.104479817 |
| 212 | E | G | 0.207077093 | 0.167731322 |
| 118 | G | V | 0.20699607 | 0.113451465 |
| 841 | G | P | 0.20698149 | 0.160303912 |
| 501 | S | R | 0.206963691 | 0.188972116 |
| 402 | L | M | 0.206953352 | 0.103953797 |
| 642 | — | EVLDSSN (SEQ ID NO: 3792) | 0.206944663 | 0.088763805 |
| 426 | — | KKVEGLS (SEQ ID NO: 3793) | 0.206944663 | 0.120828794 |
| 273 | — | LA | 0.206944663 | 0.200099204 |
| 631 | AL | DR | 0.206944663 | 0.132545056 |
| 75 | E | V | 0.206746722 | 0.108008381 |
| 159 | — | NVSEHER (SEQ ID NO: 3794) | 0.206678079 | 0.108971025 |
| 974 | — | K | 0.206678079 | 0.087902725 |
| 13 | L | I | 0.206678079 | 0.17404612 |
| 135 | P | L | 0.206613655 | 0.11493052 |
| 576 | D | N | 0.206571359 | 0.197674836 |
| 396 | — | YQ | 0.206474109 | 0.165665557 |
| 426 | K | R | 0.206261752 | 0.175070461 |
| 720 | R | S | 0.206187746 | 0.130762963 |
| 731 | D | H | 0.206140141 | 0.18515671 |
| 792 | — | PSKTY (SEQ ID NO: 3795) | 0.206037621 | 0.119445689 |
| 470 | — | ADKDEFC (SEQ ID NO: 3796) | 0.206037621 | 0.160849031 |
| 846 | — | VEGQ (SEQ ID NO: 3797) | 0.205946011 | 0.115023996 |
| 730 | — | ADDMV (SEQ ID NO: 3798) | 0.205946011 | 0.203904239 |
| 195 | F | S | 0.205931771 | 0.0997168 |
| 763 | R | G | 0.205931024 | 0.177755816 |
| 668 | A | G | 0.205831825 | 0.181720031 |
| 123 | T | I | 0.205810457 | 0.169798366 |
| 394 | A | G | 0.205790009 | 0.129212763 |
| 776 | T | N | 0.205770287 | 0.088016724 |
| 779 | P | D | 0.205703015 | 0.117547264 |
| 787 | A | G | 0.205542455 | 0.113825299 |
| 448 | S | C | 0.205480956 | 0.165327281 |
| 341 | V | L | 0.205333121 | 0.121382241 |
| 351 | K | [stop] | 0.205260708 | 0.137391414 |
| 408 | K | [stop] | 0.205233141 | 0.101895161 |
| 626 | R | [stop] | 0.204917321 | 0.133170214 |
| 426 | K | N | 0.204813329 | 0.115277631 |
| 217 | N | D | 0.204605492 | 0.15571936 |
| 55 | P | A | 0.204194052 | 0.203451056 |
| 979 | L-E | VSSK (SEQ ID NO: 3669) | 0.204463305 | 0.104199954 |
| 789 | EG | GD | 0.204429605 | 0.094907378 |
| 174 | P | H | 0.204410022 | 0.192547659 |
| 37 | T | I | 0.20435056 | 0.108024009 |
| 230 | D | Y | 0.204310577 | 0.163888419 |
| 369 | A | D | 0.204246596 | 0.143255593 |

TABLE 6-continued

Fold enrichment of CasX DME Variants

| Pos. | Ref. | Alt. | Med. Enrich. | 95% CI |
|---|---|---|---|---|
| 567 | V | L | 0.204221782 | 0.133245956 |
| 356 | E | G | 0.204079788 | 0.096784994 |
| 826 | E | G | 0.204045427 | 0.079692638 |
| 234 | — | GAVASF (SEQ ID NO: 3936) | 0.203921342 | 0.148635343 |
| 791 | — | LP | 0.203921342 | 0.086381396 |
| 550 | F | Y | 0.203856294 | 0.154808557 |
| 139 | Y | H | 0.203748432 | 0.112669732 |
| 842 | K | E | 0.203739019 | 0.14619773 |
| 565 | E | D | 0.203689065 | 0.115937226 |
| 667 | IA | TV | 0.203650432 | 0.146532587 |
| 554 | — | RFYTV (SEQ ID NO: 4123) | 0.203650432 | 0.085651298 |
| 481 | — | KLQKW (SEQ ID NO: 4006) | 0.203650432 | 0.173739202 |
| 64 | A | V | 0.203579261 | 0.147026682 |
| 429 | E | K | 0.203478388 | 0.197959656 |
| 659 | R | W | 0.203469266 | 0.155374384 |
| 775 | Y | [stop] | 0.203457477 | 0.112309611 |
| 420 | A | P | 0.203276202 | 0.137871454 |
| 844 | — | LK | 0.20327417 | 0.108693201 |
| 543 | KK | DR | 0.20327417 | 0.081409516 |
| 483 | QK | DR | 0.203103924 | 0.108226373 |
| 661 | E-N | DHSRD (SEQ ID NO: 3886) | 0.203103924 | 0.080468187 |
| 591 | — | QGREFIWN (SEQ ID NO: 4103) | 0.203103924 | 0.127711804 |
| 434 | — | HIKLE (SEQ ID NO: 3963) | 0.203103924 | 0.128782985 |
| 192 | A | D | 0.203101012 | 0.088663269 |
| 979 | LE | VW | 0.203097285 | 0.114357374 |
| 905 | V | E | 0.2029568 | 0.158582123 |
| 648 | N | K | 0.202865781 | 0.076554962 |
| 811 | N | D | 0.202736819 | 0.184175153 |
| 573 | F | Y | 0.202703202 | 0.143842683 |
| 388 | K | E | 0.202623765 | 0.1173393 |
| 265 | K | [stop] | 0.202622408 | 0.159704419 |
| 511 | Q | E | 0.202512176 | 0.199826141 |
| 375 | E | Q | 0.202480508 | 0.162732896 |
| 106 | N | K | 0.202431652 | 0.125127347 |
| 52 | E | G | 0.202421366 | 0.17180627 |
| 597 | W | [stop] | 0.202346989 | 0.135138719 |
| 153 | N | K | 0.202320957 | 0.084739162 |
| 471 | D | E | 0.202309983 | 0.069685161 |
| 486 | Y | H | 0.202105792 | 0.189019359 |
| 732 | D | V | 0.202045584 | 0.172766987 |
| 833 | T | I | 0.202003023 | 0.114654955 |
| 220 | A | D | 0.201986226 | 0.167650811 |
| 386 | D | G | 0.201893421 | 0.144223833 |
| 271 | N | K | 0.201821721 | 0.136225013 |
| 236 | VA | -C | 0.201781577 | 0.118494484 |
| 661 | E | Q | 0.201717523 | 0.126595353 |
| 644 | L | M | 0.201626647 | 0.191409491 |
| 326 | K | E | 0.201516415 | 0.172628702 |
| 584 | P | T | 0.201277532 | 0.157595812 |
| 216 | G | A | 0.201151425 | 0.135718161 |
| 158 | C | R | 0.200895575 | 0.132515505 |
| 557 | T | P | 0.20079665 | 0.175823626 |
| 615 | — | VIEKTLY (SEQ ID NO: 4209) | 0.20079665 | 0.14533527 |
| 121 | R | I | 0.200425228 | 0.146944719 |
| 67 | N | K | 0.200404848 | 0.19495599 |
| 258 | E | G | 0.200396788 | 0.144009482 |
| 232 | — | CM | 0.200312143 | 0.13867079 |
| 526 | — | LN | 0.200312143 | 0.15960761 |
| 202 | -RE | SSS | 0.200312143 | 0.113603268 |
| 68 | K | T | 0.200238961 | 0.196349346 |
| 448 | S | Y | 0.200204468 | 0.144800694 |
| 837 | — | TTI | 0.200162181 | 0.089943784 |
| 158 | — | CNVSE (SEQ ID NO: 3872) | 0.200162181 | 0.088327822 |
| 796 | — | YLSKTLA (SEQ ID NO: 4265) | 0.200048174 | 0.1285851 |
| 276 | — | PK | 0.200048174 | 0.079289415 |
| 801 | — | LAQY (SEQ ID NO: 4027) | 0.200048174 | 0.196038539 |

TABLE 6-continued

Fold enrichment of CasX DME Variants

| Pos. | Ref. | Alt. | Med. Enrich. | 95% CI |
|---|---|---|---|---|
| 651 | — | PMNLI (SEQ ID NO: 4092) | 0.200048174 | 0.135317157 |
| 756 | — | N | 0.200048174 | 0.172777109 |
| 149 | | KPHTNY (SEQ ID NO: 4012) | 0.200048174 | 0.109852809 |
| 494 | — | FA | 0.200048174 | 0.123840308 |
| 181 | V | I | 0.19996686 | 0.166465973 |
| 616 | I | M | 0.19990025 | 0.183539616 |
| 227 | A | — | 0.199865011 | 0.119483676 |
| 866 | S | R | 0.199834101 | 0.105100812 |
| 664 | — | PAVIALT (SEQ ID NO: 4085) | 0.199723054 | 0.116432821 |
| 955 | R | W | 0.199719648 | 0.122422647 |
| 507 | G | A | 0.199700659 | 0.133738835 |
| 925 | — | ALNI (SEQ ID NO: 3855) | 0.199681554 | 0.112069534 |
| 419 | — | EAW | 0.199681554 | 0.151874009 |
| 663 | I | N | 0.199667187 | 0.147345549 |
| 845 | K | R | 0.199649448 | 0.119477749 |
| 782 | L | V | 0.199620025 | 0.156520261 |
| 173 | K | E | 0.199587002 | 0.098249426 |
| 615 | — | VIEKTLYN (SEQ ID NO: 4210) | 0.199584873 | 0.182641156 |
| 630 | P | A | 0.199530215 | 0.103804567 |
| 446 | AQ | DR | 0.199529716 | 0.10633379 |
| 374 | Q | [stop] | 0.199329379 | 0.131990193 |
| 778 | M | K | 0.199291554 | 0.158456568 |
| 858 | R | S | 0.199265103 | 0.108121324 |
| 579 | N | I | 0.19915895 | 0.103520322 |
| 63 | R | G | 0.199095742 | 0.127135026 |
| 646 | S | I | 0.199062518 | 0.104634011 |
| 90 | K | E | 0.199052878 | 0.198240775 |
| 439 | E | Q | 0.198907882 | 0.179263601 |
| 621 | Y | C | 0.198885865 | 0.125823263 |
| 310 | Q | H | 0.198723557 | 0.146313995 |
| 60 | N | K | 0.198659421 | 0.192782927 |
| 299 | Q | R | 0.1986231 | 0.112149973 |
| 203 | — | ES | 0.19897765 | 0.14607778 |
| 279 | T | S | 0.198506775 | 0.126696973 |
| 278 | I | N | 0.198457202 | 0.188794837 |
| 462 | — | FV | 0.198353725 | 0.132924725 |
| 264 | — | LK | 0.198353725 | 0.107390522 |
| 296 | — | VVAQ (SEQ ID NO: 4249) | 0.198353725 | 0.116995821 |
| 152 | T | I | 0.198333224 | 0.117839718 |
| 720 | R | G | 0.198275202 | 0.180739318 |
| 236 | V | L | 0.198162379 | 0.091047961 |
| 903 | R | [stop] | 0.197764314 | 0.184873287 |
| 190 | Q | [stop] | 0.197676182 | 0.135507554 |
| 19 | TK | PG | 0.197606812 | 0.087295898 |
| 554 | R | [stop] | 0.197270424 | 0.119115645 |
| 63 | R | K | 0.197266572 | 0.156106069 |
| 671 | D | Y | 0.197186873 | 0.193857965 |
| 380 | YL | T [stop] | 0.197159823 | 0.186882164 |
| 210 | P | R | 0.197120998 | 0.088119535 |
| 637 | T | S | 0.196993711 | 0.074085124 |
| 657 | I | M | 0.196919314 | 0.094328263 |
| 458 | — | AK | 0.196819897 | 0.136384351 |
| 304 | V | F | 0.196773726 | 0.171052025 |
| 263 | N | K | 0.196728929 | 0.082781462 |
| 601 | L | V | 0.196677335 | 0.163553469 |
| 545 | I | N | 0.196522854 | 0.15815205 |
| 571 | VN | AV | 0.196419899 | 0.093569564 |
| 284 | — | PHTKE (SEQ ID NO: 4090) | 0.196419899 | 0.146831822 |
| 163 | -HE | PTR | 0.196323235 | 0.180126799 |
| 57 | P | L | 0.196165872 | 0.129483671 |
| 659 | R | P | 0.196165872 | 0.140190097 |
| 784 | A | P | 0.196137855 | 0.183129066 |
| 323 | Q | H | 0.196115938 | 0.150227482 |
| 763 | R | W | 0.195967691 | 0.113028792 |
| 257 | N | Y | 0.195936425 | 0.189617104 |
| 125 | S | G | 0.19588405 | 0.126337645 |
| 787 | A | T | 0.195855224 | 0.170500255 |
| 213 | Q | L | 0.195810372 | 0.164285983 |
| 979 | — | VSS | 0.195756097 | 0.115771783 |

TABLE 6-continued

Fold enrichment of CasX DME Variants

| Pos. | Ref. | Alt. | Med. Enrich. | 95% CI |
|---|---|---|---|---|
| 466 | G | D | 0.195631404 | 0.128114426 |
| 388 | K | R | 0.195529616 | 0.155892093 |
| 767 | R | K | 0.195477683 | 0.182282632 |
| 673 | E | V | 0.195473785 | 0.111723182 |
| 864 | D | Y | 0.195306139 | 0.092331083 |
| 885 | I | K | 0.195258477 | 0.131521124 |
| 856 | Y | C | 0.195214677 | 0.129834532 |
| 205 | N | S | 0.194826059 | 0.070507132 |
| 696 | S | R | 0.194740876 | 0.106074027 |
| 498 | A | Y | 0.194435389 | 0.108630638 |
| 281 | P | H | 0.194325757 | 0.164586878 |
| 106 | N | D | 0.194156411 | 0.113601316 |
| 756 | — | NLS | 0.194120313 | 0.113317678 |
| 591 | — | QGRE (SEQ ID NO: 4102) | 0.194120313 | 0.089464524 |
| 572 | N | D | 0.194049735 | 0.182872987 |
| 762 | G | S | 0.193891502 | 0.138436771 |
| 41 | R | [stop] | 0.193882715 | 0.149226534 |
| 370 | G | D | 0.193873435 | 0.131402011 |
| 58 | I | T | 0.193827338 | 0.18015548 |
| 64 | A | S | 0.193814684 | 0.163559402 |
| 203 | E | G | 0.193809853 | 0.182009134 |
| 318 | E | K | 0.193618764 | 0.182298755 |
| 867 | V | L | 0.193526313 | 0.149480344 |
| 343 | W | [stop] | 0.193259223 | 0.086409476 |
| 920 | — | AAEQ (SEQ ID NO: 3841) | 0.1932196 | 0.09807778 |
| 559 | I | N | 0.193172208 | 0.185545361 |
| 577 | D | E | 0.193102893 | 0.104761592 |
| 721 | K | N | 0.193081281 | 0.123219324 |
| 767 | R | S | 0.19293341 | 0.180949858 |
| 353 | L | P | 0.192916533 | 0.142447603 |
| 662 | N | D | 0.192798707 | 0.113762689 |
| 87 | E | G | 0.192780117 | 0.1542337 |
| 347 | V | G | 0.192656101 | 0.11936042 |
| 440 | E | Q | 0.192625703 | 0.16228978 |
| 698 | K | N | 0.192440231 | 0.067040488 |
| 757 | L | Q | 0.192392703 | 0.11735809 |
| 446 | — | AQSK (SEQ ID NO: 3862) | 0.192307738 | 0.188279486 |
| 91 | D | Y | 0.192222499 | 0.161107527 |
| 65 | N | K | 0.192152721 | 0.086051749 |
| 228 | L | Q | 0.192019982 | 0.075226208 |
| 107 | I | N | 0.191587572 | 0.153969194 |
| 307 | N | S | 0.191540821 | 0.186358955 |
| 944 | QT | PV | 0.191151442 | 0.133263263 |
| 526 | — | LNLYLI (SEQ ID NO: 4049) | 0.191451442 | 0.098341333 |
| 750 | -A | LS | 0.191451442 | 0.07841082 |
| 651 | — | PMN | 0.191451442 | 0.159749911 |
| 370 | — | GYKRQ (SEQ ID NO: 3959) | 0.191451442 | 0.172523736 |
| 654 | L | V | 0.191441378 | 0.100236525 |
| 332 | P | L | 0.191427852 | 0.132400599 |
| 724 | S | G | 0.191322798 | 0.15242.4888 |
| 206 | H | D | 0.191266107 | 0.183831734 |
| 594 | E | D | 0.191101272 | 0.114552929 |
| 525 | K | E | 0.190973602 | 0.101119046 |
| 576 | D | E | 0.190942249 | 0.134849057 |
| 663 | I | V | 0.190923863 | 0.098130963 |
| 225 | G | A | 0.190920356 | 0.167486936 |
| 227 | A | V | 0.190541259 | 0.158522801 |
| 539 | — | KLRF (SEQ ID NO: 4007) | 0.190525892 | 0.118424918 |
| 336 | — | RQANEVD (SEQ ID NO: 4133) | 0.190525892 | 0.095546149 |
| 511 | — | QYN | 0.190525892 | 0.10542285 |
| 182 | — | TY | 0.190525892 | 0.095282059 |
| 955 | R | K | 0.190477708 | 0.163763612 |
| 669 | L | V | 0.190343627 | 0.076107876 |
| 492 | K | Q | 0.190290589 | 0.150334427 |
| 721 | K | E | 0.190242607 | 0.123347897 |
| 389 | K | E | 0.190239723 | 0.177951808 |
| 619 | T | I | 0.190153498 | 0.116807589 |
| 93 | V | E | 0.190153374 | 0.163133537 |
| 336 | R | G | 0.190122687 | 0.099072113 |

TABLE 6-continued

Fold enrichment of CasX DME Variants

| Pos. | Ref. | Alt. | Med. Enrich. | 95% CI |
|---|---|---|---|---|
| 481 | — | KLQ | 0.190063819 | 0.144467422 |
| 878 | N | K | 0.190097445 | 0.16631012 |
| 847 | — | EG | 0.190063819 | 0.165413398 |
| 655 | I | N | 0.190024208 | 0.138898845 |
| 696 | S- | TG | 0.189908515 | 0.068382259 |
| 55 | P | R | 0.189907461 | 0.115309052 |
| 269 | S | N | 0.18989023 | 0.150359662 |
| 210 | P | L | 0.189875815 | 0.142379934 |
| 798 | S | V | 0.18982788 | 0.189131471 |
| 258 | E | K | 0.189676636 | 0.183203558 |
| 190 | Q | P | 0.189645523 | 0.168321089 |
| 377 | L | V | 0.189542806 | 0.136436344 |
| 500 | N | S | 0.189535073 | 0.180860478 |
| 295 | N | S | 0.18951855 | 0.108197323 |
| 974 | K | [stop] | 0.189482309 | 0.139647592 |
| 54 | I | V | 0.189429698 | 0.1555694 |
| 736 | N | D | 0.189336313 | 0.075796871 |
| 505 | I | N | 0.189099927 | 0.151637022 |
| 396 | Y | H | 0.189044775 | 0.129353397 |
| 117 | D | V | 0.188915066 | 0.132090825 |
| 8 | K | M | 0.188755388 | 0.159809948 |
| 699 | E | K | 0.188739566 | 0.092771182 |
| 132 | C | G | 0.188700628 | 0.133537793 |
| 338 | A | V | 0.188698117 | 0.151434141 |
| 641 | R | [stop] | 0.188367145 | 0.11062471 |
| 208 | V | L | 0.188333358 | 0.080207667 |
| 207 | P | T | 0.188302368 | 0.15553127 |
| 936 | — | RSQEYK (SEQ ID NO: 4140) | 0.188141846 | 0.120467426 |
| 428 | VE | AV | 0.188141846 | 0.111936388 |
| 419 | — | EAWE (SEQ ID NO: 3905) | 0.188141846 | 0.161004571 |
| 148 | — | GKPHTN (SEQ ID NO: 3947) | 0.188141846 | 0.126152225 |
| 972 | — | VWKPA (SEQ ID NO: 4251) | 0.188111846 | 0.100559027 |
| 328 | F | S | 0.188082476 | 0.152191585 |
| 596 | I | N | 0.188043065 | 0.141822306 |
| 482 | L | V | 0.187880246 | 0.186391629 |
| 582 | I | V | 0.18725447 | 0.136748728 |
| 699 | E | Q | 0.187137878 | 0.176072109 |
| 758 | S | I | 0.18709104 | 0.158068821 |
| 113 | I | N | 0.187005943 | 0.142849404 |
| 968 | K | E | 0.186636923 | 0.128956962 |
| 168 | — | LLSPH (SEQ ID NO: 4045) | 0.186576707 | 0.08269231 |
| 833 | TGWM (SEQ ID NO: 3832) | PAG[stop] | 0.186576707 | 0.125195246 |
| 272 | — | GLAFPIK (SEQ ID NO: 3949) | 0.186576707 | 0.060722091 |
| 529 | — | YLIIN (SEQ ID NO: 4264) | 0.186576707 | 0.104569212 |
| 261 | — | LANLKD (SEQ ID NO: 4026) | 0.186576707 | 0.081389931 |
| 884 | W | [stop] | 0.18656617 | 0.16960295 |
| 719 | S | F | 0.186508523 | 0.176978743 |
| 879 | N | K | 0.186386792 | 0.12079248 |
| 712 | Q | L | 0.186379419 | 0.129128012 |
| 583 | L | P | 0.186146799 | 0.156442099 |
| 323 | — | QRLK (SEQ ID NO: 4111) | 0.186069265 | 0.110701992 |
| 358 | — | KEDG (SEQ ID NO: 3989) | 0.18604711 | 0.119601341 |
| 835 | — | WM | 0.18604741 | 0.100790291 |
| 839 | — | INGKELK (SEQ ID NO: 3977) | 0.18604741 | 0.115878922 |
| 463 | V | E | 0.186017541 | 0.06776571 |
| 299 | Q | H | 0.185842115 | 0.085070655 |
| 832 | A | C | 0.185822701 | 0.103905008 |
| 127 | F | Y | 0.185786991 | 0.140080792 |
| 159 | N | S | 0.185693031 | 0.145375399 |
| 532 | — | IN | 0.185685948 | 0.088889817 |
| 439 | — | EERRS (SEQ ID NO: 3908) | 0.185685948 | 0.095520154 |
| 152 | — | TN | 0.185685948 | 0.085877547 |
| 684 | — | LGN | 0.18563709 | 0.122810431 |

TABLE 6-continued

| Fold enrichment of CasX DME Variants | | | | |
|---|---|---|---|---|
| Pos. | Ref. | Alt. | Med. Enrich. | 95% CI |
| 718 | Y | [stop] | 0.185557951 | 0.073176523 |
| 585 | L | P | 0.185474446 | 0.130833458 |
| 85 | W | R | 0.185353654 | 0.134359698 |
| 931 | — | SWLFL (SEQ ID NO: 4178) | 0.185304071 | 0.113870586 |
| 543 | — | KKIK (SEQ ID NO: 3996) | 0.185304071 | 0.066752877 |
| 547 | — | PEAFEAN (SEQ ID NO: 4088) | 0.185304071 | 0.089391329 |
| 91 | D | G | 0.1853036 | 0.092089143 |
| 766 | K | R | 0.185284272 | 0.110005204 |
| 461 | — | SFVIE (SEQ ID NO: 4150) | 0.185264915 | 0.156592075 |
| 950 | — | GNTDK (SEQ ID NO: 3953) | 0.185264915 | 0.154386625 |
| 825 | L | M | 0.185209061 | 0.126951087 |
| 727 | K | M | 0.185134776 | 0.155871835 |
| 28 | M | K | 0.1848853 | 0.176098567 |
| 404 | H | R | 0.184633168 | 0.163423927 |
| 394 | A | T | 0.184555363 | 0.1424277 |
| 581 | I | F | 0.184470581 | 0.083013305 |
| 766 | K | M | 0.184394313 | 0.16735316 |
| 547 | P | L | 0.18.4346525 | 0.155161861 |
| 275 | F | S | 0.184250266 | 0.085183481 |
| 537 | G | V | 0.184185986 | 0.146420736 |
| 873 | S | N | 0.184149692 | 0.143102895 |
| 198 | -I | CL | 0.184139991 | 0.106675461 |
| 639 | — | ERR | 0.184139991 | 0.11669463 |
| 287 | -K | CL | 0.184067988 | 0.105370778 |
| 404 | H | N | 0.183958455 | 0.132891407 |
| 710 | — | VEQRR (SEQ ID NO: 4207) | 0.183918384 | 0.104439918 |
| 889 | S | P | 0.183788189 | 0.164091129 |
| 144 | V | L | 0.183743996 | 0.065170935 |
| 165 | R | K | 0.183736362 | 0.17610787 |
| 28 | M | V | 0.183560659 | 0.134087452 |
| 611 | A | T | 0.183558778 | 0.136945744 |
| 148 | GK | DR | 0.183483799 | 0.153480995 |
| 515 | A | C | 0.183483799 | 0.109594032 |
| 367 | N | S | 0.183341948 | 0.159877593 |
| 868 | E | K | 0.183187044 | 0.163165035 |
| 306 | L | Q | 0.183120006 | 0.156397405 |
| 216 | G | D | 0.183066489 | 0.119789101 |
| 728 | N | Y | 0.183065668 | 0.166304554 |
| 879 | N | I | 0.183004606 | 0.128653405 |
| 126 | G | V | 0.182789208 | 0.179342988 |
| 35 | V | M | 0.182763396 | 0.156289233 |
| 443 | S | N | 0.182633222 | 0.162446869 |
| 951 | N | D | 0.182629417 | 0.175906154 |
| 410 | G | S | 0.182624091 | 0.128840332 |
| 233 | V | V | 0.182567289 | 0.115088116 |
| 96 | M | L | 0.182378018 | 0.128312349 |
| 753 | — | IFANLS (SEQ ID NO: 3974) | 0.182269944 | 0.088037483 |
| 634 | V | A | 0.182243984 | 0.121794563 |
| 556 | Y | S | 0.182208476 | 0.102238152 |
| 972 | — | VWKPAV (SEQ ID NO: 4252)[stop] | 0.182135365 | 0.122971859 |
| 716 | G | D | 0.182118038 | 0.088377906 |
| 419 | E | G | 0.182093842 | 0.165354368 |
| 145 | N | K | 0.181832601 | 0.074663212 |
| 652 | M | R | 0.181725898 | 0.15882275 |
| 183 | Y | [stop] | 0.181723054 | 0.087766244 |
| 229 | S | R | 0.18162155 | 0.118611624 |
| 589 | K | E | 0.181594685 | 0.120760487 |
| 304 | V | I | 0.181591972 | 0.14363826 |
| 873 | S | C | 0.181321853 | 0.144241543 |
| 114 | P | S | 0.181260379 | 0.131437002 |
| 100 | A | S | 0.181149523 | 0.170663024 |
| 413 | W | [stop] | 0.181066052 | 0.139390154 |
| 166 | L | M | 0.180963828 | 0.128703075 |
| 496 | — | IEAENS (SEQ ID NO: 3970) | 0.180890191 | 0.096196015 |
| 504 | D | V | 0.180843532 | 0.116307526 |
| 199 | H | Q | 0.180819165 | 0.098967075 |
| 675 | C | W | 0.180770613 | 0.172891211 |

TABLE 6-continued

| Fold enrichment of CasX DME Variants | | | | |
|---|---|---|---|---|
| Pos. | Ref. | Alt. | Med. Enrich. | 95% CI |
| 94 | G | S | 0.180639091 | 0.140246364 |
| 212 | E | D | 0.180617877 | 0.126552831 |
| 557 | T | N | 0.180519556 | 0.15369828 |
| 753 | I | S | 0.180492647 | 0.165598334 |
| 872 | L | V | 0.180432435 | 0.164444609 |
| 596 | — | IWNDLL (SEQ ID NO: 3984) | 0.180218478 | 0.160627748 |
| 382 | SS | CL | 0.180218478 | 0.105067529 |
| 369 | AG | DS | 0.180218478 | 0.132171137 |
| 757 | LS | PV | 0.180218478 | 0.120148198 |
| 674 | — | GCPLSRFK (SEQ ID NO: 3938) | 0.180218478 | 0.119094301 |
| 418 | — | DE | 0.180218478 | 0.162709755 |
| 702 | — | RTIQAAK (SEQ ID NO: 4145) | 0.180179308 | 0.102882749 |
| 81 | L | P | 0.180116381 | 0.137095425 |
| 939 | — | EYK | 0.18007812 | 0.13192478 |
| 31 | L | Q | 0.180015666 | 0.152602881 |
| 213 | — | QIGGN (SEQ ID NO: 4104) | 0.179890016 | 0.080439406 |
| 379 | — | PY | 0.179789203 | 0.118280148 |
| 331 | F | Y | 0.179617168 | 0.14637274 |
| 540 | L | M | 0.179584486 | 0.167412262 |
| 693 | I | V | 0.179569128 | 0.124539552 |
| 776 | T | S | 0.179453432 | 0.075575874 |
| 264 | L | V | 0.179340275 | 0.144429387 |
| 547 | P | R | 0.179333799 | 0.110886672 |
| 820 | D | E | 0.179273983 | 0.124243775 |
| 604 | E | K | 0.17907609 | 0.153006263 |
| 651 | P | S | 0.17907291 | 0.16196086 |
| 382 | S | C | 0.179061797 | 0.042397129 |
| 680 | F | Y | 0.179026865 | 0.083849485 |
| 552 | A | V | 0.178983921 | 0.137645246 |
| 693 | I | F | 0.178916903 | 0.17080226 |
| 151 | HT | LS | 0.178787645 | 0.11267363 |
| 190 | — | QRALD (SEQ ID NO: 4109) | 0.178787645 | 0.150480322 |
| 208 | — | VKPLE (SEQ ID NO: 4211) | 0.178787645 | 0.112763983 |
| 194 | D | V | 0.178645393 | 0.146182868 |
| 163 | H | R | 0.178633884 | 0.108142143 |
| 383 | I | I | 0.178486259 | 0.158810182 |
| 156 | G | D | 0.178426488 | 0.134868493 |
| 234 | G | E | 0.178414368 | 0.12320748 |
| 804 | Y | [stop] | 0.178116642 | 0.169884859 |
| 582 | I | N | 0.177915368 | 0.151449157 |
| 655 | I | T | 0.177824888 | 0.131979099 |
| 129 | C | Y | 0.177764169 | 0.131217004 |
| 20 | K | [stop] | 0.177744686 | 0.162022223 |
| 852 | Y | C | 0.177655192 | 0.126363222 |
| 179 | E | Q | 0.177438027 | 0.163530401 |
| 365 | W | S | 0.177330558 | 0.12784352 |
| 245 | D | E | 0.177288135 | 0.128142583 |
| 593 | R | G | 0.177150053 | 0.165372274 |
| 838 | T | S | 0.177144418 | 0.166381063 |
| 979 | LE[stop]G | VSSR (SEQ ID NO: 4248) | 0.177037198 | 0.160568847 |
| 265 | K | E | 0.176890073 | 0.124809095 |
| 440 | E | D | 0.176868582 | 0.097257257 |
| 107 | I | M | 0.176863119 | 0.14397231 |
| 22 | A | P | 0.176753805 | 0.123959084 |
| 292 | A | G | 0.176665583 | 0.159949136 |
| 803 | Q | [stop] | 0.176624558 | 0.101059884 |
| 329 | P | S | 0.176586746 | 0.173503743 |
| 196 | Y | [stop] | 0.176517802 | 0.122355941 |
| 758 | S | N | 0.176368261 | 0.089480066 |
| 298 | A | T | 0.176357721 | 0.087659893 |
| 333 | L | V | 0.176333899 | 0.163860363 |
| 518 | W | R | 0.176185261 | 0.104632883 |
| 459 | KA | -V | 0.176164273 | 0.103778218 |
| 192 | AL | DR | 0.176164273 | 0.079837153 |
| 979 | LE-[stop]G | VSSKDLQA (SEQ ID NO: 3671) | 0.176164273 | 0.074531926 |
| 35 | VMT | ETA | 0.176164273 | 0.104758915 |
| 767 | RT | SC | 0.176164273 | 0.119651092 |
| 678 | S | N | 0.176147348 | 0.146692604 |

TABLE 6-continued

Fold enrichment of CasX DME Variants

| Pos. | Ref. | Alt. | Med. Enrich. | 95% CI |
|------|------|------|--------------|--------|
| 817 | T | A | 0.176123605 | 0.120992816 |
| 635 | A | G | 0.176061926 | 0.119367224 |
| 212 | E | A | 0.175873239 | 0.11085302 |
| 821 | Y | [stop] | 0.175384143 | 0.118184345 |
| 447 | Q | R | 0.175284629 | 0.123528707 |
| 257 | N | S | 0.175186561 | 0.099304683 |
| 618 | K | R | 0.175178956 | 0.153225543 |
| 217 | N | S | 0.175170771 | 0.153898212 |
| 852 | Y | [stop] | 0.175104531 | 0.090584521 |
| 255 | K | R | 0.175069831 | 0.070668507 |
| 430 | — | GLS | 0.175035484 | 0.093564105 |
| 827 | — | KLKK (SEQ ID NO: 4004) | 0.175035484 | 0.069987475 |
| 796 | — | YLS | 0.175035484 | 0.092544675 |
| 414 | — | GKVYDEAWE (SEQ ID NO: 3948) | 0.175035484 | 0.140128399 |
| 547 | — | PEAFE (SEQ ID NO: 4087) | 0.175035484 | 0.118947618 |
| 186 | — | GKFGQR (SEQ ID NO: 3946) | 0.175035484 | 0.092907507 |
| 580 | L | R | 0.174993228 | 0.092760152 |
| 422 | E | K | 0.174900558 | 0.171745203 |
| 285 | H | Y | 0.17.4862549 | 0.137793142 |
| 737 | T | I | 0.174757975 | 0.115488534 |
| 455 | W | G | 0.174674459 | 0.156270727 |
| 401 | L | P | 0.174440338 | 0.064966394 |
| 953 | — | DKR | 0.17.4181069 | 0.090682808 |
| 953 | — | DKRA (SEQ ID NO: 3890) | 0.174181069 | 0.085814279 |
| 360 | D | N | 0.174161173 | 0.117286104 |
| 520 | K | E | 0.174117735 | 0.143263172 |
| 145 | N | D | 0.174107257 | 0.119744646 |
| 819 | — | ADYD (SEQ ID NO: 3846) | 0.174068679 | 0.17309276 |
| 561 | K | [stop] | 0.174057181 | 0.086009056 |
| 761 | F | S | 0.17403349 | 0.168753775 |
| 563 | S | P | 0.173902999 | 0.138700996 |
| 70 | L | P | 0.173882613 | 0.120818159 |
| 24 | K | [stop] | 0.173808747 | 0.113872328 |
| 834 | G | A | 0.173722333 | 0.117168406 |
| 167 | I | N | 0.173700086 | 0.14772793 |
| 496 | — | IEAENSILD (SEQ ID NO: 3972) | 0.173653508 | 0.110162475 |
| 618 | K | [stop] | 0.173508668 | 0.101750483 |
| 297 | V | E | 0.173261294 | 0.132967549 |
| 426 | K | E | 0.173245682 | 0.081642461 |
| 182 | T | K | 0.173138422 | 0.156579716 |
| 660 | G | S | 0.17299716 | 0.158169348 |
| 805 | T | S | 0.172972548 | 0.12868971 |
| 458 | A | S | 0.172827968 | 0.144714634 |
| 731 | D | V | 0.172739834 | 0.130565896 |
| 829 | K | E | 0.172710008 | 0.121812751 |
| 859 | Q | [stop] | 0.172627299 | 0.130823394 |
| 305 | — | NL | 0.172611068 | 0.12831984 |
| 178 | — | DE | 0.172611068 | 0.108355628 |
| 652 | M | V | 0.172566944 | 0.106266804 |
| 582 | I | M | 0.172413921 | 0.144870464 |
| 335 | E | G | 0.172324707 | 0.120749484 |
| 940 | — | YK | 0.172247171 | 0.104630004 |
| 450 | A | D | 0.172235862 | 0.15659478 |
| 187 | K | T | 0.172165735 | 0.159986695 |
| 289 | GI | AV | 0.172163889 | 0.117287191 |
| 579 | NL | DR | 0.172163889 | 0.094383078 |
| 813 | E | G | 0.172115298 | 0.163114025 |
| 259 | K | E | 0.171933606 | 0.128545463 |
| 255 | K | M | 0.171890748 | 0.139268571 |
| 675 | — | CP | 0.171877476 | 0.064917248 |
| 853 | Y | C | 0.171733581 | 0.087723362 |
| 631 | A | V | 0.171731995 | 0.15053602 |
| 668 | A | V | 0.171647872 | 0.129168631 |
| 508 | F | S | 0.17126701 | 0.136692573 |
| 925 | AL | DR | 0.17104011 | 0.083554381 |
| 437 | — | LE | 0.17104041 | 0.06885585 |
| 853 | — | YN | 0.17104041 | 0.123300185 |
| 797 | — | LSKILA (SEQ ID NO: 4057) | 0.17104041 | 0.064415402 |

TABLE 6-continued

Fold enrichment of CasX DME Variants

| Pos. | Ref. | Alt. | Med. Enrich. | 95% CI |
|---|---|---|---|---|
| 815 | — | TIT | 0.17104041 | 0.104377719 |
| 462 | -FV | ERL[stop] | 0.17104041 | 0.089353273 |
| 471 | — | DK | 0.17104041 | 0.0730883 |
| 418 | — | DEAWE (SEQ ID NO: 3879) | 0.170904662 | 0.126366449 |
| 213 | — | QIG | 0.170882441 | 0.117196646 |
| 703 | — | TIQA (SEQ ID NO: 4189) | 0.170763645 | 0.147647998 |
| 356 | E | A | 0.170659559 | 0.127216719 |
| 869 | L | V | 0.170596065 | 0.1158133 |
| 106 | NI | TV | 0.170299453 | 0.164756763 |
| 160 | V | L | 0.170273865 | 0.111449611 |
| 163 | H | Q | 0.170101095 | 0.104599592 |
| 210 | P | T | 0.170021527 | 0.150133417 |
| 748 | QD | R- | 0.169874659 | 0.074658631 |
| 775 | — | YIRMED (SEQ ID NO: 4272) | 0.169874659 | 0.080414628 |
| 513 | N | I | 0.169811112 | 0.150139289 |
| 743 | — | YY | 0.169783049 | 0.088429509 |
| 467 | — | LKEADKD (SEQ ID NO: 4041) | 0.169783049 | 0.163043441 |
| 663 | -I | CL | 0.169783049 | 0.106475808 |
| 803 | — | QYTSKT (SEQ ID NO: 4117) | 0.169772888 | 0.094792337 |
| 808 | — | TCSNCG (SEQ ID NO: 4182) | 0.169772888 | 0.089412307 |
| 845 | K | E | 0.169715078 | 0.127028772 |
| 552 | A | T | 0.169382091 | 0.146396839 |
| 476 | C | F | 0.169278987 | 0.093974927 |
| 711 | E | D | 0.169174495 | 0.118203075 |
| 631 | A | S | 0.169116909 | 0.130583861 |
| 303 | W | [stop] | 0.169003266 | 0.078930757 |
| 561 | K | I | 0.168954178 | 0.166308652 |
| 157 | — | RC | 0.168739459 | 0.094824256 |
| 721 | K | R | 0.168620063 | 0.147491806 |
| 614 | R | [stop] | 0.168568195 | 0.15863634 |
| 611 | A | D | 0.168315642 | 0.157590847 |
| 78 | K | [stop] | 0.168282214 | 0.125424128 |
| 917 | — | ETHA (SEQ ID NO: 3919) | 0.168207257 | 0.122439321 |
| 756 | NL | DR | 0.168207257 | 0.079944251 |
| 678 | S | G | 0.168124453 | 0.111226188 |
| 525 | K | I | 0.16804127 | 0.142310409 |
| 653 | N | K | 0.167953422 | 0.124668308 |
| 37 | T | N | 0.16794635 | 0.137106698 |
| 174 | P | S | 0.167775884 | 0.122107474 |
| 756 | — | NLSR (SEQ ID NO: 4074) | 0.167679572 | 0.073550026 |
| 168 | — | LLSPHK (SEQ ID NO: 4046) | 0.167679572 | 0.081935755 |
| 160 | — | VSEHERLI (SEQ ID NO: 4219) | 0.167679572 | 0.116191677 |
| 859 | — | QNVVK (SEQ ID NO: 4107) | 0.167565632 | 0.122604368 |
| 719 | S | P | 0.167206156 | 0.083551442 |
| 712 | Q | R | 0.167205037 | 0.147128575 |
| 964 | F | S | 0.166884399 | 0.138397154 |
| 359 | E | G | 0.16680448 | 0.139659272 |
| 191 | R | K | 0.166577954 | 0.144007057 |
| 339 | N | D | 0.166374831 | 0.157063101 |
| 212 | E | K | 0.166305352 | 0.157035199 |
| 413 | WG | LS | 0.166270685 | 0.125303472 |
| 149 | — | KP | 0.166270685 | 0.076773688 |
| 284 | — | PHTK (SEQ ID NO: 4089) | 0.166270685 | 0.139854804 |
| 146 | D | N | 0.166006779 | 0.113823305 |
| 686 | N | D | 0.165853975 | 0.141480032 |
| 492 | K | R | 0.16571672 | 0.088451245 |
| 580 | LI | PV | 0.165563978 | 0.079217211 |
| 661 | — | ENI | 0.165563978 | 0.126675099 |
| 829 | K | R | 0.165378823 | 0.103172827 |
| 608 | L | V | 0.165024412 | 0.161094218 |
| 451 | — | ALT | 0.164823895 | 0.158152194 |
| 581 | II | TV | 0.164823895 | 0.074002626 |
| 297 | — | VAQI (SEQ ID NO: 4199) | 0.164823895 | 0.107420642 |

TABLE 6-continued

Fold enrichment of CasX DME Variants

| Pos. | Ref. | Alt. | Med. Enrich. | 95% CI |
|---|---|---|---|---|
| 783 | — | T | 0.164823895 | 0.135845679 |
| 496 | I | V | 0.164665656 | 0.140996169 |
| 979 | LE[stop]G | VSSE (SEQ ID NO: 4223) | 0.164491714 | 0.145714149 |
| 932 | — | WLFL (SEQ ID NO: 4254) | 0.164491714 | 0.083188044 |
| 637 | — | TFERRE (SEQ ID NO: 4186) | 0.164491714 | 0.152633112 |
| 325 | — | LKG | 0.164491714 | 0.125129505 |
| 630 | — | PALE (SEQ ID NO: 4083) | 0.164491714 | 0.073996533 |
| 343 | — | WWDMV (SEQ ID NO: 4259) | 0.164491714 | 0.076194534 |
| 642 | — | EV | 0.164491714 | 0.162646605 |
| 419 | — | EAWER (SEQ ID NO: 3906) | 0.164491714 | 0.082157078 |
| 360 | — | DG | 0.164491714 | 0.073133393 |
| 408 | K | E | 0.16446662 | 0.067392631 |
| 48 | R | G | 0.164301321 | 0.157884797 |
| 613 | G | D | 0.164218988 | 0.127296459 |
| 175 | — | EANDE (SEQ ID NO: 3904) | 0.164149182 | 0.111610409 |
| 671 | D | E | 0.16.4120916 | 0.112217289 |
| 794 | — | KTYLSKT (SEQ ID NO: 4020) | 0.16411942 | 0.087804343 |
| 599 | — | DLLSLE (SEQ ID NO: 3895) | 0.16411942 | 0.120903184 |
| 58 | I- | LS | 0.16411942 | 0.094001227 |
| 826 | E | D | 0.163807302 | 0.112540279 |
| 889 | S | [stop] | 0.163771981 | 0.149267099 |
| 199 | | PRLY (SEQ ID NO: 4094) | 0.163715064 | 0.07899198 |
| 916 | FET | VQA | 0.163715064 | 0.085074401 |
| 496 | — | IEAENSI (SEQ ID NO: 3971) | 0.163715064 | 0.073631578 |
| 164 | — | ERLI (SEQ ID NO: 3916) | 0.163715064 | 0.124419929 |
| 345 | D | G | 0.16357556 | 0.12500461 |
| 134 | Q | [stop] | 0.163522049 | 0.142382805 |
| 764 | — | QGKRTFM (SEQ ID NO: 4101) | 0.163440941 | 0.098647738 |
| 107 | I | T | 0.163178218 | 0.154967966 |
| 633 | FVAL (SEQ ID NO: 3807) | LWP[stop] | 0.163026367 | 0.076347451 |
| 213 | — | QI | 0.163026367 | 0.09979216 |
| 186 | — | GKFGQ (SEQ ID NO: 3945) | 0.163026367 | 0.114909103 |
| 592 | G | D | 0.162807696 | 0.109433096 |
| 257 | N | K | 0.162725471 | 0.091658038 |
| 473 | DE | YH | 0.162404215 | 0.086992333 |
| 975 | P | A | 0.162340126 | 0.074611129 |
| 833 | T | A | 0.162275301 | 0.096163195 |
| 871 | R | S | 0.162178581 | 0.080758991 |
| 909 | — | EVCLN (SEQ ID NO: 3934) | 0.162125073 | 0.14885021 |
| 341 | — | VD | 0.162125073 | 0.111287809 |
| 57 | PI | DS | 0.162125073 | 0.110736083 |
| 83 | VY | AV | 0.162125073 | 0.121259318 |
| 643 | — | VLD | 0.162125073 | 0.148280778 |
| 561 | K | N | 0.161973573 | 0.145314105 |
| 349 | N | K | 0.161796683 | 0.105713204 |
| 318 | E | R | 0.161659235 | 0.066441966 |
| 554 | — | RF | 0.161611946 | 0.149093192 |
| 505 | I | F | 0.161489243 | 0.076235653 |
| 102 | P | T | 0.161386248 | 0.119400583 |
| 514 | CA | LS | 0.16113532 | 0.083183292 |
| 979 | — | VSSKDLQ (SEQ ID NO: 3667) | 0.161025471 | 0.108550491 |
| 445 | D | Y | 0.161008394 | 0.118993907 |
| 143 | Q | K | 0.160693826 | 0.130109004 |
| 547 | P | S | 0.160635883 | 0.144061844 |
| 43 | R | Q | 0.160624353 | 0.132247177 |
| 317 | D | E | 0.160609141 | 0.14140596 |
| 807 | K | [stop] | 0.160484146 | 0.104229856 |
| 572 | N | S | 0.160431799 | 0.062377966 |
| 644 | LD | PV | 0.160242602 | 0.128569608 |

TABLE 6-continued

Fold enrichment of CasX DME Variants

| Pos. | Ref. | Alt. | Med. Enrich. | 95% CI |
|---|---|---|---|---|
| 699 | EK | DR | 0.160242602 | 0.092172248 |
| 850 | I | V | 0.160226988 | 0.152692033 |
| 100 | AQ | LS | 0.160110772 | 0.101933413 |
| 558 | VI | CL | 0.160110772 | 0.10892714 |
| 270 | — | AN | 0.160110772 | 0.124579798 |
| 979 | LE[stop]GS-PGIK (SEQ ID NO: 3665)[stop] | VSSKDLQASNT (SEQ ID NO: 4233) | 0.160110772 | 0.049257177 |
| 484 | K-WYGD (SEQ ID NO: 3821) | NSSLSASF (SEQ ID NO: 4076) | 0.160110772 | 0.077521171 |
| 205 | NH | LS | 0.160110772 | 0.08695461 |
| 281 | P | C | 0.160110772 | 0.141761431 |
| 939 | E | R | 0.160110772 | 0.106121188 |
| 672 | — | S | 0.160110772 | 0.105653932 |
| 894 | — | SLLKKRFS (SEQ ID NO: 4166) | 0.160110772 | 0.071577892 |
| 199 | HV | T[stop] | 0.160110772 | 0.129212095 |
| 47 | L | Q | 0.159718064 | 0.101565653 |
| 262 | A | V | 0.159650297 | 0.156994685 |
| 788 | — | YEGLPS (SEQ ID NO: 4261) | 0.159522485 | 0.129386966 |
| 529 | Y | N | 0.159442162 | 0.135286632 |
| 604 | E | V | 0.159292857 | 0.097301034 |
| 284 | P | S | 0.159001205 | 0.153355474 |
| 750 | A | D | 0.158401706 | 0.125762435 |
| 950 | G | A | 0.158324371 | 0.153957854 |
| 688 | T | I | 0.158292674 | 0.119969439 |
| 29 | K | N | 0.158279304 | 0.142748603 |
| 372 | K | R | 0.158267712 | 0.11920003 |
| 275 | F | L | 0.158241303 | 0.120299703 |
| 741 | L | P | 0.158158865 | 0.120228264 |
| 430 | G | V | 0.158115277 | 0.126566194 |
| 921 | — | AEQ | 0.158108573 | 0.11103467 |
| 242 | K | E | 0.158032112 | 0.1512035 |
| 148 | GK | RQ | 0.158026029 | 0.155853601 |
| 295 | — | NV | 0.157603522 | 0.100157866 |
| 876 | — | SVNN (SEQ ID NO: 4175) | 0.157603522 | 0.131358152 |
| 215 | G | A | 0.157466168 | 0.125711629 |
| 319 | A | V | 0.15742503 | 0.144655841 |
| 222 | G | A | 0.157400391 | 0.107390901 |
| 523 | V | D | 0.157098281 | 0.069302906 |
| 753 | — | IFANLSR (SEQ ID NO: 3975) | 0.157085986 | 0.062378414 |
| 177 | N | S | 0.157058654 | 0.117427271 |
| 461 | S | R | 0.157014829 | 0.122688776 |
| 823 | R | T | 0.156977695 | 0.125466793 |
| 427 | K | M | 0.156963925 | 0.118535881 |
| 111 | K | [stop] | 0.156885345 | 0.101390983 |
| 253 | V | L | 0.156787797 | 0.082680225 |
| 91 | D | V | 0.156758895 | 0.14763673 |
| 71 | T | I | 0.156624998 | 0.127600056 |
| 592 | — | GREFIW (SEQ ID NO: 3955) | 0.156575371 | 0.050528735 |
| 847 | — | EGQIT (SEQ ID NO: 3911) | 0.156575371 | 0.108055014 |
| 111 | KL | S[stop] | 0.156575371 | 0.112953961 |
| 979 | L-E[stop] | VSSN (SEQ ID NO: 4243) | 0.156575311 | 0.054922359 |
| 203 | — | ESNHPV (SEQ ID NO: 3917) | 0.156575371 | 0.141927058 |
| 230 | DA | LS | 0.156575371 | 0.105363533 |
| 408 | — | KHGED (SEQ ID NO: 3993) | 0.156575371 | 0.140706352 |
| 606 | — | GSLKLAN (SEQ ID NO: 3958) | 0.156575371 | 0.154364417 |
| 166 | L | Q | 0.156435151 | 0.079474192 |
| 213 | Q | H | 0.156012357 | 0.091435578 |
| 447 | Q | E | 0.155900092 | 0.095629939 |
| 689 | H | P | 0.155877877 | 0.131928361 |
| 335 | E | Q | 0.155876225 | 0.110366115 |
| 84 | Y | D | 0.155784728 | 0.135489779 |
| 531 | I | N | 0.155410746 | 0.152604803 |
| 103 | A | S | 0.155352263 | 0.149390311 |
| 661 | E | V | 0.155230224 | 0.090301063 |

TABLE 6-continued

| Fold enrichment of CasX DME Variants | | | | |
|---|---|---|---|---|
| Pos. | Ref. | Alt. | Med. Enrich. | 95% CI |
| 865 | — | LSVELDR (SEQ ID NO: 4060) | 0.15478543 | 0.145114034 |
| 677 | LS | PV | 0.15478513 | 0.108120931 |
| 570 | E | G | 0.154599098 | 0.10691093 |
| 762 | G | D | 0.154432235 | 0.117428168 |
| 177 | N | K | 0.15431964 | 0.1416948 |
| 484 | K | N | 0.154291635 | 0.117621744 |
| 592 | GRE- | DNQVG (SEQ ID NO: 3898) | 0.154254957 | 0.077027283 |
| 704 | — | IQAAK (SEQ ID NO: 3979) | 0.154254957 | 0.108682368 |
| 285 | — | HTKEG (SEQ ID NO: 3966) | 0.154254957 | 0.106587271 |
| 721 | KY | TV | 0.154254957 | 0.124126134 |
| 650 | — | KPMNLIG (SEQ ID NO: 4014) | 0.154254957 | 0.151047576 |
| 717 | G | E | 0.15414714 | 0.124750031 |
| 667 | I | V | 0.154117319 | 0.147646705 |
| 623 | — | RRTRQ (SEQ ID NO: 4138) | 0.153993707 | 0.122323206 |
| 773 | R | G | 0.153915262 | 0.146586561 |
| 433 | — | KH | 0.153881949 | 0.097541884 |
| 35 | V | G | 0.153666817 | 0.124448628 |
| 211 | L | V | 0.153538313 | 0.134546484 |
| 26 | G | D | 0.15349539 | 0.149545585 |
| 279 | — | TLPPQ (SEQ ID NO: 4191) | 0.15339361 | 0.125011235 |
| 664 | — | PAVIAL (SEQ ID NO: 4084) | 0.15339361 | 0.13972264 |
| 377 | — | LLPY (SEQ ID NO: 4044) | 0.15339361 | 0.12480719 |
| 53 | N | D | 0.15332875 | 0.117758231 |
| 140 | K | N | 0.153228737 | 0.097346381 |
| 694 | GE | DR | 0.153190779 | 0.097274205 |
| 741 | — | LLYY (SEQ ID NO: 4047) | 0.153190779 | 0.13376095 |
| 592 | — | GREFI (SEQ ID NO: 3954) | 0.153190779 | 0.103123693 |
| 684 | — | LGNPTHI (SEQ ID NO: 4035) | 0.153117895 | 0.112048537 |
| 532 | — | INY | 0.153147895 | 0.072663729 |
| 311 | K | N | 0.153086255 | 0.08609524 |
| 678 | — | SRFKD (SEQ ID NO: 4171) | 0.152422378 | 0.09122337 |
| 969 | LK | PV | 0.152422378 | 0.0541377 |
| 419 | EAWERIDKKV (SEQ ID NO: 3804) | RPGRESTRRW (SEQ ID NO: 4131) | 0.152422378 | 0.081179935 |
| 670 | — | TD | 0.152422378 | 0.096788119 |
| 383 | — | SEE | 0.152422378 | 0.066189551 |
| 403 | — | LHLE (SEQ ID NO: 4036) | 0.152422378 | 0.132942463 |
| 389 | KG | TV | 0.152422378 | 0.11037889 |
| 850 | — | ITYYN (SEQ ID NO: 3982) | 0.152422378 | 0.102611165 |
| 230 | — | DAMGAV (SEQ ID NO: 3874) | 0.152422378 | 0.082337669 |
| 461 | — | SFVI (SEQ ID NO: 4149) | 0.1524.22378 | 0.085894307 |
| 673 | E- | DR | 0.1524.22378 | 0.059554386 |
| 257 | N | D | 0.152411625 | 0.106853984 |
| 590 | R | G | 0.152081011 | 0.117905973 |
| 737 | T | N | 0.151886476 | 0.142783247 |
| 790 | G | E | 0.151825437 | 0.098317165 |
| 831 | T | S | 0.151806143 | 0.14386859 |
| 906 | QE | PV | 0.151695593 | 0.100183043 |
| 99 | V | D | 0.151565952 | 0.12300149 |
| 959 | — | ETW | 0.151393972 | 0.086210639 |
| 520 | K | R | 0.151365824 | 0.113621271 |
| 852 | Y | N | 0.151328449 | 0.137543743 |
| 444 | E | G | 0.151257656 | 0.118296919 |
| 147 | — | KGK | 0.15109455 | 0.054833005 |
| 171 | — | PH | 0.15109455 | 0.08380172 |
| 925 | — | ALN | 0.15109455 | 0.138412128 |
| 539 | — | KLRFK (SEQ ID NO: 4008) | 0.15109455 | 0.128926028 |

TABLE 6-continued

| | Fold enrichment of CasX DME Variants | | | |
|---|---|---|---|---|
| Pos. | Ref. | Alt. | Med. Enrich. | 95% CI |
| 334 | — | VERQANE (SEQ ID NO: 4208) | 0.15109455 | 0.059721295 |
| 484 | KW | TG | 0.15109455 | 0.091510022 |
| 848 | G- | AV | 0.15109455 | 0.104352239 |
| 236 | — | VASFLT (SEQ ID NO: 4201) | 0.15109455 | 0.088006138 |
| 880 | — | DIS | 0.15109455 | 0.085164607 |
| 296 | VV | DR | 0.15109455 | 0.140218943 |
| 293 | YN | DS | 0.15109455 | 0.094395956 |
| 359 | ED | AV | 0.15109455 | 0.062026733 |
| 210 | PL | RQ | 0.15109455 | 0.109823159 |
| 758 | S- | TG | 0.15109455 | 0.105413113 |
| 232 | CM | LS | 0.15109455 | 0.096388212 |
| 930 | RSWLFL (SEQ ID NO: 3775) | EAGCS (SEQ ID NO: 3903)[stop] | 0.15109455 | 0.077157167 |
| 886 | KG | C- | 0.15109455 | 0.085064934 |
| 594 | EF | DC | 0.15109455 | 0.055097165 |
| 140 | K | [stop] | 0.150604639 | 0.124522684 |
| 979 | LE[stop]GS- | VSSKDI (SEQ ID NO: 4228) | 0.150527572 | 0.113935287 |
| 979 | L-E[stop]G | VSSKA (SEQ R) NO: 4225) | 0.150527572 | 0.106493096 |
| 851 | T | A | 0.150513073 | 0.138771627 |
| 615 | V | A | 0.150425208 | 0.101961366 |
| 359 | — | E | 0.150399286 | 0.136024193 |
| 508 | | FSKQYN (SEQ ID NO: 3929) | 0.150399286 | 0.049469473 |
| 202 | R- | SSSLASGL (SEQ ID NO: 4174)[stop] (SEQ ID NO: 4174) | 0.150399286 | 0.07714146 |
| 884 | — | WTKGR (SEQ ID NO: 4257) | 0.150399286 | 0.084711675 |
| 399 | — | GDLLLH (SEQ ID NO: 3939) | 0.150399286 | 0.08514719 |
| 39 | D | G | 0.150354378 | 0.13986784 |
| 891 | E | V | 0.150263535 | 0.113865674 |
| 450 | A | P | 0.150166455 | 0.146935336 |
| 429 | E | D | 0.149933575 | 0.107236607 |
| 77 | K | E | 0.148931072 | 0.079170957 |
| 259 | — | KRLANLKD (SEQ ID NO: 4018) | 0.148805792 | 0.108390156 |
| 978 | [stop]L | GI | 0.148805792 | 0.119775179 |
| 386 | D- | AV | 0.148805792 | 0.079572543 |
| 748 | QD | PV | 0.148805792 | 0.094563395 |
| 609 | KL | DR | 0.148805792 | 0.060702366 |
| 699 | EK | DC | 0.148805792 | 0.122863259 |
| 279 | — | TLP | 0.148805792 | 0.138832536 |
| 24 | K | M | 0.148782741 | 0.14630409 |
| 798 | S | T | 0.148583442 | 0.105674096 |
| 349 | N | S | 0.148310626 | 0.138528822 |
| 403 | — | LH | 0.148273333 | 0.102736 |
| 967 | — | KKLKEVW (SEQ ID NO: 3999) | 0.148059201 | 0.11964291 |
| 157 | RC | LS | 0.14801524 | 0.133243315 |
| 493 | PF | TV | 0.1480152.1 | 0.059147928 |
| 188 | — | FGQRALD (SEQ ID NO: 3925) | 0.14801524 | 0.10137508 |
| 898 | KR | TG | 0.14801524 | 0.120213578 |
| 186 | — | GK | 0.14801524 | 0.114746024 |
| 328 | F- | LS | 0.14801524 | 0.071716609 |
| 204 | — | SNHPVKP (SEQ ID NO: 4168) | 0.14801524 | 0.094645672 |
| 314 | — | IG | 0.14801524 | 0.075655093 |
| 422 | ER | AV | 0.14801524 | 0.044733928 |
| 64 | AN | DS | 0.14801524 | 0.108571015 |
| 855 | — | RY | 0.14801524 | 0.108772293 |
| 504 | D | E | 0.147876758 | 0.098656217 |
| 342 | D | H | 0.147844774 | 0.140125334 |
| 86 | EE | DR | 0.147451251 | 0.143531987 |
| 240 | — | LTKY (SEQ ID NO: 4061) | 0.147451251 | 0.080958956 |
| 942 | KY | NC | 0.147451251 | 0.116243971 |
| 47 | LR | C- | 0.147451251 | 0.058888218 |
| 807 | KT | -C | 0.147451251 | 0.120603495 |
| 603 | LE | PV | 0.147451251 | 0.066385351 |
| 873 | — | SEE | 0.147451251 | 0.078348652 |

TABLE 6-continued

| Fold enrichment of CasX DME Variants | | | | |
|---|---|---|---|---|
| Pos. | Ref. | Alt. | Med. Enrich. | 95% CI |
| 15 | KD | R- | 0.147451251 | 0.123855007 |
| 206 | HP | DS | 0.147451251 | 0.064383902 |
| 599 | DL | — | 0.147451251 | 0.079608104 |
| 979 | L-E[stop]GS | VSSKDP (SEQ ID NO: 4237) | 0.147451251 | 0.049212446 |
| 979 | LE[stop]GS-PGIK (SEQ ID NO: 3665)[stop] | VSSNDLQASNK (SEQ ID NO: 4247) | 0.147451251 | 0.067765787 |
| 448 | — | SK | 0.147451251 | 0.090898875 |
| 505 | I- | LS | 0.147451251 | 0.077683234 |
| 398 | FG | SV | 0.147451251 | 0.073631355 |
| 512 | -Y | DS | 0.147451251 | 0.05128316 |
| 345 | — | DMVC (SEQ ID NO: 3896) | 0.147451251 | 0.06441585 |
| 177 | ND- | FTG[stop] | 0.147451251 | 0.085413531 |
| 36 | MT | C- | 0.147451251 | 0.118494367 |
| 953 | D- | AV | 0.147451251 | 0.040719542 |
| 451 | AL | DR | 0.147451251 | 0.096339405 |
| 631 | A | C | 0.147319263 | 0.109020371 |
| 848 | G | A | 0.147279724 | 0.093306967 |
| 239 | F | S | 0.147177048 | 0.142500129 |
| 270 | A | I | 0.147117218 | 0.13621963 |
| 352 | K | N | 0.147067273 | 0.12109567 |
| 563 | S | I | 0.147049099 | 0.111696976 |
| 612 | N | K | 0.146927237 | 0.108594483 |
| 569 | M | V | 0.146754771 | 0.119310335 |
| 940 | -Y | SV | 0.14673352 | 0.076906931 |
| 794 | KT | NC | 0.14673352 | 0.093083088 |
| 487 | — | GDLR (SEQ ID NO: 3940) | 0.14673352 | 0.141269601 |
| 717 | — | GY | 0.14673352 | 0.129086357 |
| 468 | — | KEAD (SEQ ID NO: 3987) | 0.14673352 | 0.112176586 |
| 102 | P | L | 0.146729077 | 0.094784801 |
| 462 | F | V | 0.146714745 | 0.123539268 |
| 291 | E | Q | 0.146533408 | 0.078647294 |
| 657 | — | IDRGEN (SEQ ID NO: 3969) | 0.146511494 | 0.145489762 |
| 32 | L | F | 0.146467882 | 0.099225719 |
| 619 | T | N | 0.146372017 | 0.145146105 |
| 355 | N | K | 0.146341962 | 0.141209887 |
| 132 | C | S | 0.146274101 | 0.131138669 |
| 831 | T | A | 0.146217161 | 0.113775751 |
| 868 | E | V | 0.145780526 | 0.143894902 |
| 231 | A | P | 0.14576396 | 0.105172115 |
| 944 | — | QTNKT (SEQ ID NO: 4115) | 0.14564914 | 0.125394667 |
| 236 | — | VASFL (SEQ ID NO: 4200) | 0.14564914 | 0.09085897 |
| 709 | — | EV | 0.14564914 | 0.119119066 |
| 865 | L | P | 0.145527367 | 0.10928669 |
| 510 | — | KQYN (SEQ ID NO: 4015) | 0.145296444 | 0.112653295 |
| 959 | — | ET | 0.145296444 | 0.114339851 |
| 414 | G | V | 0.1451247 | 0.140131131 |
| 465 | E | G | 0.144909944 | 0.124547249 |
| 300 | I | T | 0.144877384 | 0.129206612 |
| 215 | G | S | 0.144824715 | 0.07809376 |
| 288 | E | G | 0.144744415 | 0.110082872 |
| 16 | D | N | 0.144678092 | 0.139073977 |
| 855 | R | G | 0.144425593 | 0.123370913 |
| 617 | E | V | 0.144206082 | 0.126166622 |
| 918 | — | THAAEQAA (SEQ ID NO: 4188) | 0.143857661 | 0.070236443 |
| 733 | — | MVRN (SEQ ID NO: 4065) | 0.143791778 | 0.090612696 |
| 217 | NS | TG | 0.143791778 | 0.113745581 |
| 657 | — | IARGE (SEQ ID NO: 3968) | 0.143791778 | 0.039293361 |
| 533 | N | S | 0.14375365 | 0.085993529 |
| 185 | — | LGKFGQRA (SEQ ID NO: 4034) | 0.14367777 | 0.094952199 |
| 616 | — | IEKTLYN (SEQ ID NO: 3973) | 0.14367777 | 0.110151228 |
| 668 | — | ALTDPE (SEQ ID NO: 3858) | 0.14367777 | 0.113895553 |

TABLE 6-continued

Fold enrichment of CasX DME Variants

| Pos. | Ref. | Alt. | Med. Enrich. | 95% CI |
|---|---|---|---|---|
| 259 | — | KRLA (SEQ ID NO: 4017) | 0.14367777 | 0.070148108 |
| 175 | E- | DR | 0.14367777 | 0.049065425 |
| 610 | — | LANGRV (SEQ ID NO: 4025) | 0.14367777 | 0.105216814 |
| 507 | — | GESKQYN (SEQ ID NO: 3943) | 0.14367777 | 0.101689858 |
| 487 | — | GDL | 0.14367777 | 0.046711447 |
| 731 | DD | CL | 0.14367777 | 0.067816779 |
| 265 | KD | R- | 0.14367777 | 0.130304386 |
| 386 | — | DRK | 0.14367777 | 0.092432212 |
| 790 | — | GLPSK (SEQ ID NO: 3951) | 0.14367777 | 0.104428158 |
| 774 | QY | PV | 0.14367777 | 0.076535556 |
| 910 | — | VC | 0.14367777 | 0.024273265 |
| 484 | KW | DR | 0.14367777 | 0.094175463 |
| 20 | — | CL | 0.14367777 | 0.08704024 |
| 847 | — | EGQITYYN (SEQ ID NO: 3912) | 0.14367777 | 0.054370233 |
| 114 | P | L | 0.143623976 | 0.107371623 |
| 294 | N | S | 0.143486731 | 0.084830242 |
| 473 | D | G | 0.143465301 | 0.122194432 |
| 376 | A | I | 0.1434567 | 0.101440197 |
| 637 | T | A | 0.143296115 | 0.114711319 |
| 365 | W | C | 0.143131818 | 0.093254266 |
| 559 | I | S | 0.142993499 | 0.107801059 |
| 671 | D | S | 0.142731931 | 0.123439168 |
| 487 | — | GDLRGK (SEQ ID NO: 3941) | 0.14265438 | 0.086040474 |
| 211 | LEQIG (SEQ ID NO: 3825) | RNRSA (SEQ ID NO: 4127) | 0.14265438 | 0.100691421 |
| 26 | GP | CL | 0.14265438 | 0.067388407 |
| 421 | — | WE | 0.14265438 | 0.084239003 |
| 211 | — | LEQI (SEQ ID NO: 4030) | 0.14265438 | 0.118588014 |
| 767 | R | [stop] | 0.1.41592128 | 0.123403074 |
| 290 | I | N | 0.141531787 | 0.136370873 |
| 774 | Q | [stop] | 0.141517184 | 0.125118121 |
| 341 | V | E | 0.14127686 | 0.094518287 |
| 176 | A | S | 0.140653486 | 0.112098857 |
| 562 | K | N | 0.140512419 | 0.126501373 |
| 317 | D | H | 0.140493859 | 0.124148887 |
| 941 | — | KKYQTN (SEQ ID NO: 4002) | 0.140217655 | 0.077001548 |
| 147 | — | KGKPHTNY (SEQ ID NO: 3992) | 0.140217655 | 0.060731949 |
| 979 | LE[stop]GS- | VSSKDV (SEQ ID NO: 4238) | 0.140217655 | 0.126849347 |
| 342 | — | D | 0.140217655 | 0.083180031 |
| 701 | — | QRTIQA (SEQ ID NO: 4113) | 0.140217655 | 0.094973524 |
| 588 | G | R | 0.140077599 | 0.123307802 |
| 248 | L | V | 0.139838145 | 0.132091481 |
| 641 | R | G | 0.139811399 | 0.120984089 |
| 375 | E | G | 0.13977585 | 0.117490416 |
| 179 | E | K | 0.139614148 | 0.122113279 |
| 285 | — | HTK | 0.139514563 | 0.076217964 |
| 166 | — | LI | 0.139514563 | 0.075733937 |
| 786 | — | LAYE (SEQ ID NO: 4028) | 0.139514563 | 0.068877295 |
| 274 | AF | TV | 0.139413376 | 0.092095094 |
| 578 | — | PN | 0.139413376 | 0.112737023 |
| 775 | — | YTRME (SEQ ID NO: 4271) | 0.13869596 | 0.096841774 |
| 838 | TING (SEQ ID NO: 3833) | PSTA (SEQ ID NO: 4095) | 0.13869596 | 0.135948561 |
| 75 | E | K | 0.138622423 | 0.112055782 |
| 556 | Y | C | 0.138477684 | 0.131330328 |
| 98 | R | [stop] | 0.138179687 | 0.102036322 |
| 460 | A | I | 0.137813435 | 0.108501414 |
| 111 | K | N | 0.137723187 | 0.11828435 |
| 566 | I | F | 0.137434779 | 0.130961132 |
| 438 | — | EEERRS (SEQ ID NO: 3907) | 0.137192189 | 0.064149715 |
| 58 | I | M | 0.13705694 | 0.089110339 |
| 826 | E | K | 0.136937076 | 0.066669616 |

TABLE 6-continued

| Fold enrichment of CasX DME Variants | | | | |
|---|---|---|---|---|
| Pos. | Ref. | Alt. | Med. Enrich. | 95% CI |
| 955 | R | T | 0.136388186 | 0.086919652 |
| 400 | — | DLLLH (SEQ ID NO: 3892) | 0.136321349 | 0.064628042 |
| 163 | — | HERLILL (SEQ ID NO: 3962) | 0.136321349 | 0.117792482 |
| 950 | — | G | 0.136321349 | 0.089773613 |
| 353 | — | LINEKKE (SEQ ID NO: 4039) | 0.136321349 | 0.11384298 |
| 469 | — | EADKDEFC (SEQ ID NO: 3901) | 0.136321349 | 0.136235916 |
| 298 | — | AQIVIW (SEQ ID NO: 3861) | 0.136321349 | 0.124259801 |
| 967 | — | KKL | 0.136321349 | 0.087024226 |
| 834 | G | D | 0.136317736 | 0.131556677 |
| 675 | C | S | 0.135933989 | 0.124817499 |
| 295 | N | D | 0.135903192 | 0.116385268 |
| 489 | L | P | 0.135710175 | 0.113005835 |
| 316 | R | W | 0.135665116 | 0.08159144 |
| 782 | L | P | 0.135444097 | 0.094158481 |
| 252 | K | I | 0.135215444 | 0.118419704 |
| 703 | — | TI | 0.135116856 | 0.093813019 |
| 671 | — | DPE | 0.135116856 | 0.117221994 |
| 763 | R | Q | 0.135073853 | 0.130952104 |
| 815 | T | S | 0.135026549 | 0.096980291 |
| 141 | L | M | 0.134960075 | 0.098794232 |
| 789 | E | K | 0.134893603 | 0.120008321 |
| 36 | M | L | 0.13488937 | 0.122340012 |
| 278 | I | F | 0.134789571 | 0.111040576 |
| 913 | NCGFET (SEQ ID NO: 3827) | EAAVQA (SEQ ID NO: 3900) | 0.134611486 | 0.113195929 |
| 11 | -R | AS | 0.134611486 | 0.123271552 |
| 978 | [stop]LE[stop]GS-PG (SEQ ID NO: 3668) | YVSSKDLQA (SEQ ID NO: 4277) | 0.134611486 | 0.087096491 |
| 247 | — | ILEHQK (SEQ ID NO: 3976) | 0.134611486 | 0.104206673 |
| 517 | I | I | 0.134524102 | 0.104605605 |
| 18 | N | Y | 0.134422379 | 0.132333464 |
| 804 | — | YTSK (SEQ ID NO: 4273) | 0.134383084 | 0.102298299 |
| 872 | — | LSEESVN (SEQ ID NO: 4056) | 0.134383084 | 0.104954479 |
| 743 | Y | H | 0.134286698 | 0.08203884 |
| 250 | H | Q | 0.134238241 | 0.111012466 |
| 268 | A | P | 0.134027791 | 0.098451313 |
| 978 | [stop]LE[stop]GSPG (SEQ ID NO: 3668) | YVSSIDLQ (SEQ ID NO: 4276) | 0.134010909 | 0.133274253 |
| 664 | — | PA | 0.134010909 | 0.124393367 |
| 979 | LE[stop]G- | VSSND (SEQ ID NO: 4244) | 0.133919467 | 0.126494561 |
| 241 | T | N | 0.133870518 | 0.110803484 |
| 153 | N | S | 0.133623126 | 0.12555263 |
| 196 | Y | H | 0.133619017 | 0.107174466 |
| 744 | Y- | LS | 0.133358224 | 0.114892564 |
| 633 | F | S | 0.133277029 | 0.122435158 |
| 619 | T | S | 0.133139525 | 0.08963831 |
| 742 | L | P | 0.133131448 | 0.09127341 |
| 809 | C | [stop] | 0.133028515 | 0.072072201 |
| 86 | E | D | 0.132733699 | 0.128073996 |
| 473 | D | V | 0.132562245 | 0.055193421 |
| 358 | K | I | 0.132508402 | 0.120198091 |
| 476 | — | C | 0.132326289 | 0.087739647 |
| 953 | DK | E- | 0.132326289 | 0.066036843 |
| 770 | — | MAERQY (SEQ ID NO: 4064) | 0.132326289 | 0.083381966 |
| 887 | — | GRSGEAL (SEQ ID NO: 3957) | 0.132326289 | 0.072961347 |
| 630 | P | S | 0.132221835 | 0.08064538 |
| 290 | I | T | 0.132066117 | 0.101441805 |
| 81 | L | Q | 0.132063026 | 0.114766305 |
| 809 | C | F | 0.131888449 | 0.093326725 |
| 497 | — | EAENSIL (SEQ ID NO: 3902) | 0.131863052 | 0.100142921 |
| 717 | — | GYSRK (SEQ ID NO: 3960) | 0.131863052 | 0.112950153 |

TABLE 6-continued

Fold enrichment of CasX DME Variants

| Pos. | Ref. | Alt. | Med. Enrich. | 95% CI |
|---|---|---|---|---|
| 386 | — | DRKK (SEQ ID NO: 3696) | 0.131863052 | 0.08146183 |
| 68 | KL | TV | 0.131863052 | 0.070945883 |
| 700 | KQ | DR | 0.131863052 | 0.063471315 |
| 831 | TAT | PPP | 0.131863052 | 0.067816715 |
| 157 | — | RCNVS (SEQ ID NO: 3697) | 0.131863052 | 0.080937513 |
| 953 | — | DKRAEV (SEQ ID NO: 3891) | 0.131771442 | 0.07848717 |
| 978 | [stop]L | GF | 0.131771442 | 0.061548024 |
| 979 | LE[stop]G | VSCK (SEQ ID NO: 4216) | 0.131568591 | 0.101292375 |
| 855 | R | S | 0.131540317 | 0.054730727 |
| 128 | A | T | 0.13150991 | 0.131075942 |
| 225 | G | R | 0.131348437 | 0.12857841 |
| 874 | E | D | 0.131154993 | 0.12741404 |
| 54 | I | I | 0.130796445 | 0.072189843 |
| 568 | — | PM | 0.130626359 | 0.119168349 |
| 362 | K | Ps | 0.130604026 | 0.105840846 |
| 359 | E | V | 0.130475561 | 0.064946527 |
| 426 | — | KKVE (SEQ ID NO: 4001) | 0.130424348 | 0.109290243 |
| 300 | IV | DR | 0.130424348 | 0.08495594 |
| 893 | — | LS | 0.130424348 | 0.106896252 |
| 256 | KN | TV | 0.130424348 | 0.057621352 |
| 767 | — | RTFM (SEQ ID NO: 4143) | 0.130.424348 | 0.06446722 |
| 324 | R | G | 0.13036573 | 0.130162815 |
| 460 | A | P | 0.129809906 | 0.111386576 |
| 744 | Y | S | 0.129801283 | 0.120155085 |
| 297 | V | L | 0.1296923 | 0.098130283 |
| 979 | LE | VP | 0.129554025 | 0.068280994 |
| 595 | — | FIWNDLL (SEQ ID NO: 3927) | 0.129554025 | 0.083916268 |
| 909 | F | C | 0.129452838 | 0.12013501 |
| 39 | D | N | 0.128914064 | 0.121593627 |
| 263 | N | D | 0.128846416 | 0.111193487 |
| 403 | — | LHLEKKH (SEQ ID NO: 4038) | 0.128586666 | 0.071668629 |
| 979 | LE[stop]GS-G | VSSIDLV (SEQ ID NO: 4236) | 0.128586666 | 0.121567211 |
| 876 | — | SVNNDI (SEQ ID NO: 4176) | 0.128586666 | 0.054233667 |
| 228 | — | LSDACMG (SEQ ID NO: 4055) | 0.128586666 | 0.126842965 |
| 701 | — | QRTI (SEQ ID NO: 4112) | 0.128586666 | 0.098093616 |
| 797 | — | LSKTLAQYT (SEQ ID NO: 4058) | 0.128586666 | 0.060991971 |
| 14 | VK | AG | 0.128586666 | 0.085310723 |
| 423 | RI | LS | 0.128586666 | 0.084850033 |
| 583 | — | LP | 0.128586666 | 0.051620503 |
| 979 | LE[stop]GS-PGIK (SEQ ID NO: 3665) | VSSNDLQASN (SEQ ID NO: 4246) | 0.128586666 | 0.102476858 |
| 979 | LE[stop]GS-PGIK (SEQ ID NO: 3665)[stop] | FSSKDLQASNK (SEQ ID NO: 3933) | 0.128586666 | 0.093654912 |
| 533 | — | NY | 0.128586666 | 0.127517343 |
| 563 | — | SGEI (SEQ ID NO: 4154) | 0.128586666 | 0.112169649 |
| 979 | L-E[stop]GS | VSSKDH (SEQ ID NO: 4227) | 0.128586666 | 0.096285329 |
| 755 | — | ANLS (SEQ ID NO: 3860) | 0.12851771 | 0.091942401 |
| 4 61 | S | N | 0.128271168 | 0.11452282 |
| 8 64 | D | E | 0.128210448 | 0.108842691 |
| 84 | Y | C | 0.128022871 | 0.110536014 |
| 720 | — | RKYA (SEQ ID NO: 4126) | 0.127406426 | 0.102905352 |
| 416 | VYDEAWE (SEQ ID NO: 3840) | CTMRPG- (SEQ ID NO: 3873) | 0.127406426 | 0.059900059 |
| 808 | — | TCSN (SEQ ID NO: 4181) | 0.127406426 | 0.082184056 |
| 791 | — | LPSKTY (SEQ ID NO: 4052) | 0.127406426 | 0.108127962 |

TABLE 6-continued

| Fold enrichment of CasX DME Variants | | | | |
|---|---|---|---|---|
| Pos. | Ref. | Alt. | Med. Enrich. | 95% CI |
| 162 | — | EHERLI (SEQ ID NO: 3913) | 0.127406426 | 0.099109571 |
| 549 | — | AFEANRFY (SEQ ID NO: 3848) | 0.127406426 | 0.084837264 |
| 979 | LE[stop]GSPGI (SEQ ID NO: 3674) | VSSIDLQE (SEQ ID NO: 4234) | 0.127187739 | 0.092227907 |
| 445 | D | E | 0.127007554 | 0.122060316 |
| 82 | H | N | 0.126805938 | 0.104486705 |
| 676 | P | L | 0.126754121 | 0.080812602 |
| 951 | — | NTDK (SEQ ID NO: 4078) | 0.126641231 | 0.099218396 |
| 979 | LE[stop]GS-PGIK (SEQ ID NO: 3665)[stop] | VSSKDLQASNN (SEQ ID NO: 4232) | 0.126641231 | 0.095848514 |
| 204 | — | SNHP (SEQ ID NO: 4167) | 0.126641231 | 0.07625836 |
| 426 | KK | DR | 0.126641231 | 0.097925475 |
| 923 | QAA | PV- | 0.126641231 | 0.093158654 |
| 101 | QP | ET | 0.126641231 | 0.062121806 |
| 942 | K-Y | NCL | 0.126641231 | 0.088910569 |
| 826 | EK | AV | 0.126641231 | 0.091897908 |
| 292 | — | AYNNV (SEQ ID NO: 3871) | 0.126641231 | 0.106376872 |
| 879 | — | NDISSWT (SEQ ID NO: 4070) | 0.126641231 | 0.078787272 |
| 181 | VTYSLGKFGQ (SEQ ID NO: 3839) | -SHTAWASSD (SEQ ID NO: 4160) | 0.126641231 | 0.089695218 |
| 137 | YV | DR | 0.126641231 | 0.109693213 |
| 548 | — | EAFE | 0.126641231 | 0.095888318 |
| 858 | — | RQNVVKDL (SEQ ID NO: 4136) | 0.126641231 | 0.065591267 |
| 231 | A | C | 0.126641231 | 0.070173983 |
| 898 | KRF | NCL | 0.126641231 | 0.049641927 |
| 789 | EG | AV | 0.126641231 | 0.10544887 |
| 640 | RR | IG | 0.126641231 | 0.104632778 |
| 303 | — | WVNLN (SEQ ID NO: 4258) | 0.126641231 | 0.064376538 |
| 640 | R- | TV | 0.126641231 | 0.051697037 |
| 890 | GE | DR | 0.126641231 | 0.058497447 |
| 513 | — | NCAFIWQK (SEQ ID NO: 4069) | 0.126641231 | 0.110534935 |
| 36 | MT | TV | 0.126641231 | 0.096682191 |
| 979 | — | AV | 0.126641231 | 0.031136061 |
| 607 | — | SLK | 0.126641231 | 0.117782054 |
| 979 | LE[stop]G | FSSK (SEQ ID NO: 3931) | 0.126627253 | 0.064240928 |
| 29 | KT | LS | 0.126627253 | 0.070400509 |
| 510 | KQ-Y | SHLQ (SEQ ID NO: 4157) | 0.126602218 | 0.092982894 |
| 960 | — | TWQ | 0.12652671 | 0.053263565 |
| 665 | — | AVI | 0.12652671 | 0.057438099 |
| 675 | — | C | 0.12652671 | 0.103567194 |
| 451 | — | ALTDWLR (SEQ ID NO: 3859) | 0.12652671 | 0.081452296 |
| 805 | — | TSKTC (SEQ ID NO: 4195) | 0.12652671 | 0.07786947 |
| 890 | -GE | VAKPLLQQ (SEQ ID NO: 4198) | 0.12652671 | 0.093632788 |
| 885 | — | TK | 0.12652671 | 0.12280066 |
| 670 | — | TDPEGCP (SEQ ID NO: 4185) | 0.12652671 | 0.087582312 |
| 344 | — | WD | 0.12652671 | 0.059781458 |
| 589 | K | [stop] | 0.126002643 | 0.117169902 |
| 670 | T | I | 0.125333365 | 0.115123087 |
| 843 | E | K | 0.125307936 | 0.1170313 |
| 209 | — | KPL | 0.125145098 | 0.058688797 |
| 256 | — | KNEKR (SEQ ID NO: 4009) | 0.125115098 | 0.118773295 |
| 627 | — | QDEPALF (SEQ ID NO: 4100) | 0.125145098 | 0.11944079 |
| 637 | TF | S- | 0.125145098 | 0.075022945 |
| 846 | — | VEGQIT (SEQ ID NO: 4205) | 0.125145098 | 0.095200634 |
| 112 | LI | PV | 0.125145098 | 0.061303825 |

TABLE 6-continued

Fold enrichment of CasX DME Variants

| Pos. | Ref. | Alt. | Med. Enrich. | 95% CI |
|---|---|---|---|---|
| 592 | GRE- | DNOV (SEQ ID NO: 3897) | 0.125145098 | 0.061215515 |
| 273 | — | LAFPKIT (SEQ ID NO: 4024) | 0.125145098 | 0.062360109 |
| 773 | — | RQYT (SEQ ID NO: 4137) | 0.125145098 | 0.098790624 |
| 274 | AF | DS | 0.125145098 | 0.089301627 |
| 686 | N- | TV | 0.125145098 | 0.106327975 |
| 549 | — | A | 0.125145098 | 0.111251903 |
| 615 | — | VIE | 0.125145098 | 0.115519537 |
| 486 | Y | [stop] | 0.12498861 | 0.117668911 |
| 479 | E | G | 0.124803485 | 0.119823525 |
| 225 | G | E | 0.124549307 | 0.110077498 |
| 123 | T | N | 0.123826195 | 0.091669684 |
| 436 | K | E | 0.123328926 | 0.10928445 |
| 139 | Y | [stop] | 0.123256307 | 0.11129924 |
| 831 | T | N | 0.123113024 | 0.105004336 |
| 147 | — | KGKPHTN (SEQ ID NO: 3991) | 0.123112897 | 0.091739528 |
| 256 | — | KNE | 0.1228.14147 | 0.106923843 |
| 179 | EL | A- | 0.122844147 | 0.091584443 |
| 406 | — | EKKHG (SEQ ID NO: 3915) | 0.122844147 | 0.089153499 |
| 295 | — | NVVAQ (SEQ ID NO: 4080) | 0.122844147 | 0.103819809 |
| 658 | D | E | 0.122389699 | 0.080353294 |
| 206 | H | Q | 0.122384978 | 008971464 |
| 689 | H | Q | 0.122256431 | 0.089420446 |
| 306 | LN | PV | 0.121921649 | 0.07283705 |
| 620 | LY | PV | 0.121921649 | 0.084823364 |
| 910 | — | SG | 0.121685511 | 0.114110877 |
| 508 | — | FSKQYNCA (SEQ ID NO: 3930) | 0.121235544 | 0.060533533 |
| 314 | I | F | 0.120726616 | 0.074980055 |
| 746 | VT | C- | 0.120516649 | 0.087097894 |
| 910 | VC | CL | 0.119637812 | 0.085877084 |
| 621 | — | YNRRTR (SEQ ID NO: 4266) | 0.119637812 | 0.065553526 |
| 467 | — | LKEAD (SEQ ID NO: 4040) | 0.119637812 | 0.109940477 |
| 827 | — | KL | 0.119637812 | 0.054530509 |
| 374 | — | QEA | 0.119637812 | 0.063378708 |
| 145 | — | NDK | 0.119637812 | 0.051846935 |
| 979 | LE[stop]GSPG (SEQ ID NO: 3668) | ESSKIDLQ (SEQ ID NO: 3932) | 0.119637812 | 0.067517262 |
| 338 | — | ANE | 0.119637812 | 0.103007188 |
| 389 | KG | R- | 0.119637812 | 0.050940125 |
| 669 | — | L | 0.119637812 | 0.05675251 |
| 845 | — | KVEGQI (SEQ ID NO: 4021) | 0.119637812 | 0.06612892 |
| 400 | — | DLLLHL (SEQ ID NO: 3893) | 0.119637812 | 0.07276695 |
| 757 | L | R | 0.119502434 | 0.108713549 |
| 578 | P | L | 0.119430629 | 0.116829607 |
| 634 | VA | LS | 0.119372647 | 0.100712827 |
| 510 | K- | SHL | 0.119372647 | 0.080479619 |
| 979 | LE[stop]G | ASSK (SEQ ID NO: 3865) | 0.119372647 | 0.074447954 |
| 798 | -S | TA | 0.119372647 | 0.036802807 |
| 653 | NL | DR | 0.119372647 | 0.061028998 |
| 854 | -N | LS | 0.119372647 | 0.074161693 |
| 420 | A | S | 0.119261972 | 0.115184751 |
| 519 | — | QKD | 0.119051026 | 0.108753459 |
| 600 | LLS | PV- | 0.119011185 | 0.056536344 |
| 271 | — | NGLAFPK (SEQ ID NO: 4072) | 0.119011185 | 0.073725244 |
| 51 | P | L | 0.118978183 | 0.099712186 |
| 403 | — | LHLEK (SEQ ID NO: 4037) | 0.118963684 | 0.11518549 |
| 457 | — | RAKAS (SEQ ID NO: 4118) | 0.118963684 | 0.088377062 |
| 776 | — | TRME (SEQ ID NO: 4194) | 0.118963684 | 0.083809802 |
| 320 | KPLQRL (SEQ ID NO: 3817) | SHCRD[stop] (SEQ ID NO: 4156) | 0.118677331 | 0.073630679 |

TABLE 6-continued

Fold enrichment of CasX DME Variants

| Pos. | Ref. | Alt. | Med. Enrich. | 95% CI |
|---|---|---|---|---|
| 685 | GNPT (SEQ ID NO: 3811) | ATLH (SEQ ID NO: 3867) | 0.118677331 | 0.086334956 |
| 178 | — | DELV (SEQ ID NO: 3883) | 0.118677331 | 0.101525884 |
| 587 | — | FGKRQG (SEQ ID NO: 3924) | 0.118677331 | 0.110043529 |
| 783 | — | TAKLAN (SEQ ID NO: 4179) | 0.118677331 | 0.076704941 |
| 542 | — | FK | 0.118677331 | 0.098685141 |
| 733 | — | MVRNTAR (SEQ ID NO: 4066) | 0.118677331 | 0.078476963 |
| 396 | — | YQFG (SEQ ID NO: 4268) | 0.118677331 | 0.08225792 |
| 837 | — | TTING (SEQ ID NO: 4196) | 0.118677331 | 0.059978646 |
| 729 | L | P | 0.118360335 | 0.091091038 |
| 194 | D | E | 0.117679069 | 0.090466918 |
| 582 | ILP | SC- | 0.11732562 | 0.090313521 |
| 901 | — | SHR | 0.11712133 | 0.108.439325 |
| 67 | N | D | 0.116939695 | 0.113264127 |
| 309 | W | R | 0.116671977 | 0.111491729 |
| 74 | T | S | 0.11653877 | 0.0855649 |
| 838 | T | N | 0.116394614 | 0.094955966 |
| 137 | Y | [stop] | 0.116334699 | 0.088258455 |
| 591 | Q | [stop] | 0.116290785 | 0.093561727 |
| 686 | N | K | 0.116232458 | 0.062605741 |
| 445 | — | DAQSK (SEQ ID NO: 3875) | 0.115532631 | 0.10378499 |
| 134 | Q | P | 0.114967131 | 0.11371497 |
| 698 | — | KE | 0.114412847 | 0.098843087 |
| 701 | QR | PV | 0.114412847 | 0.104102361 |
| 281 | — | PPQ | 0.114412847 | 0.077542482 |
| 708 | K | [stop] | 0.113715295 | 0.106986973 |
| 696 | SYK | LQR | 0.113676993 | 0.07036758 |
| 703 | — | TIQ | 0.113676993 | 0.062517799 |
| 596 | I | F | 0.113504467 | 0.107709004 |
| 160 | — | VSEHE (SEQ ID NO: 4217) | 0.113504256 | 0.099167163 |
| 745 | — | AVTQD (SEQ ID NO: 3869) | 0.113504256 | 0.111375922 |
| 570 | E | K | 0.1130503 | 0.100973674 |
| 368 | L | P | 0.111983406 | 0.095724154 |
| 275 | F | Y | 0.111191948 | 0.100665217 |
| 521 | D | E | 0.111133748 | 0.10058089 |
| 562 | K | E | 0.110566391 | 0.097349138 |
| 136 | L | Q | 0.110244812 | 0.107286129 |
| 411 | E | G | 0.110174632 | 0.097582202 |
| 381 | LS | PV | 0.110164473 | 0.095898615 |
| 616 | I | V | 0.109853606 | 0.094001833 |
| 843 | E | R | 0.109803145 | 0.097494217 |
| 676 | P | H | 0.109607681 | 0.091744681 |
| 484 | KVVYG (SEQ ID NO: 3820) | NSSL (SEQ ID NO: 3763) | 0.109535927 | 0.106819917 |
| 511 | QY | PV | 0.109451554 | 0.106726398 |
| 979 | LE[stop]GSP | VSSKDV (SEQ ID NO: 4239) | 0.108902792 | 0.077647274 |
| 420 | A | V | 0.108649806 | 0.097722159 |
| 53 | N | K | 0.108567111 | 0.086753227 |
| 114 | P | A | 0.108538006 | 0.106859466 |
| 637 | — | TFERREV (SEQ ID NO: 4187) | 0.108360722 | 0.063051456 |
| 286 | TK | DR | 0.108360722 | 0.053025872 |
| 249 | EH | AV | 0.108360722 | 0.095653705 |
| 67 | NK | DR | 0.108360722 | 0.039884349 |
| 944 | — | QTNKTTG (SEQ ID NO: 4116) | 0.108360722 | 0.078648908 |
| 197 | — | SIHVIRE (SEQID NO: 4161) | 0.108360722 | 0.081689422 |
| 510 | KQYNCA (SEQ ID NO: 3818) | SHLQNS (SEQ ID NO: 4158) | 0.108360722 | 0.044585998 |
| 953 | D | C | 0.108360722 | 0.098828046 |
| 63 | RA | SC | 0.108360722 | 0.091093584 |
| 597 | — | WNDLL (SEQ ID NO: 4255) | 0.108360722 | 0.065802495 |

TABLE 6-continued

| Fold enrichment of CasX DME Variants | | | | |
|---|---|---|---|---|
| Pos. | Ref. | Alt. | Med. Enrich. | 95% CI |
| 208 | VK | CL | 0.108360722 | 0.044537036 |
| 468 | — | KEADKDE (SEQ ID NO: 3988) | 0.108360722 | 0.074432186 |
| 84 | -Y | DS | 0.108360722 | 0.088490546 |
| 496 | — | IE | 0.108360722 | 0.07371372 |
| 672 | P-E | SGCV (SEQ ID NO: 4153)[stop] | 0.108360722 | 0.07159837 |
| 910 | VC | AV | 0.108360722 | 0.062775349 |
| 868 | EL | DR | 0.108360722 | 0.050620256 |
| 235 | — | AV | 0.108360722 | 0.094955272 |
| 332 | PL | RQ | 0.108360722 | 0.062876398 |
| 461 | — | SFVIEGLK (SEQ ID NO: 4151) | 0.108360722 | 0.064022496 |
| 562 | KSGEI (SEQ ID NO: 3819) | SPAR- (SEQ ID NO: 4169) | 0.108360722 | 0.067951904 |
| 556 | — | YTVINKK (SEQ ID NO: 4274) | 0.108360722 | 0.070852948 |
| 121 | RLT | SC- | 0.108360722 | 0.070897115 |
| 868 | EL | NW | 0.108360722 | 0.108128749 |
| 715 | — | AVTQ (SEQ ID NO: 3868) | 0.108360722 | 0.088762315 |
| 513 | — | NCAFIW (SEQ ID NO: 4068) | 0.108360722 | 0.045078115 |
| 429 | — | EGLS (SEQ ID NO: 3910) | 0.108360722 | 0.046808088 |
| 615 | VI | AV | 0.108360722 | 0.089957198 |
| 927 | — | NIAR (SEQ ID NO: 4073) | 0.108360722 | 0.096224338 |
| 56 | Q | V | 0.108360722 | 0.076115958 |
| 852 | YY | C- | 0.108360722 | 0.054744482 |
| 816 | IT | LS | 0.108360722 | 0.074232993 |
| 210 | P | S | 0.108088041 | 0.085752595 |
| 251 | — | QKV | 0.107840626 | 0.092439 |
| 351 | — | KKLI (SEQ ID NO: 3997) | 0.107840626 | 0.05939446 |
| 962 | — | QSFYRKK (SEQ ID NO: 4114) | 0.107840626 | 0.060903469 |
| 594 | EFI | DCL | 0.107840626 | 0.078577001 |
| 600 | — | LLS | 0.107840626 | 0.107212137 |
| 979 | LE[stop]GS-PGIK (SEQ ID NO: 3665) | ASSKDLQASN (SEQ ID NO: 3866) | 0.107840626 | 0.073484536 |
| 606 | — | GSL | 0.107840626 | 0.104907627 |
| 604 | — | ETG | 0.107840626 | 0.105428162 |
| 473 | — | DEFCRCE (SEQ ID NO: 3882) | 0.107840626 | 0.072973962 |
| 798 | — | SKTLAQ (SEQ ID NO: 4163) | 0.107840626 | 0.085530107 |
| 607 | — | SLKLA (SEQ ID NO: 4165) | 0.107840626 | 0.087611083 |
| 705 | Q- | ET | 0.107840626 | 0.102652999 |
| 674 | — | GCPLSR (SEQ ID NO: 3937) | 0.107840626 | 0.089241733 |
| 185 | — | LGKEGQR (SEQ ID NO: 4033) | 0.107840626 | 0.068363178 |
| 344 | WD | LS | 0.107840626 | 0.066070011 |
| 274 | — | AF | 0.101840626 | 0.075101467 |
| 577 | D | G | 0.1075508 | 0.10472372 |
| 700 | K | M | 0.107451835 | 0.099853237 |
| 641 | — | RE | 0.106527066 | 0.104478931 |
| 599 | — | DLLS (SEQ ID NO: 3894) | 0.106527066 | 0.100649327 |
| 564 | GE | DR | 0.106527066 | 0.090487961 |
| 836 | MT | IC | 0.106527066 | 0.100530022 |
| 853 | — | YNRYK (SEQ ID NO: 4267) | 0.106527066 | 0.088862545 |
| 586 | — | AFGK (SEQ ID NO: 3849) | 0.106527066 | 0.08642655 |
| 275 | -F | SV | 0.106527066 | 0.099879454 |
| 429 | — | EG | 0.106527066 | 0.066947062 |
| 612 | N | T | 0.106459427 | 0.08415093 |
| 611 | — | ANG | 0.105912094 | 0.09807063 |
| 563 | — | SGEIV (SEQ ID NO: 4155) | 0.105912094 | 0.10402865 |
| 203 | E- | DR | 0.10545658 | 0.048953383 |
| 872 | — | LS | 0.10545658 | 0.08227801 |

TABLE 6-continued

Fold enrichment of CasX DME Variants

| Pos. | Ref. | Alt. | Med. Enrich. | 95% CI |
|---|---|---|---|---|
| 291 | EA | -C | 0.10545658 | 0.078263499 |
| 894 | S- | IG | 0.10545658 | 0.07781616 |
| 851 | -T | LS | 0.10545658 | 0.071676834 |
| 251 | — | OK | 0.105199237 | 0.101057895 |
| 194 | — | DFYSI (SEQ ID NO: 3884) | 0.105199237 | 0.05958457 |
| 236 | — | VAS | 0.105199237 | 0.084024149 |
| 899 | RF | SC | 0.105199237 | 0.046835281 |
| 215 | GG | CL | 0.105199237 | 0.057087854 |
| 886 | KG | TV | 0.105199237 | 0.077099458 |
| 198 | -I | TV | 0.105199237 | 0.087584827 |
| 878 | NN | DS | 0.105199237 | 0.079694461 |
| 76 | MK | IC | 0.105199237 | 0.090203405 |
| 227 | ALSDA (SEQ ID NO: 3800) | SPERR (SEQ ID NO: 4170) | 0.105199237 | 0.101107303 |
| 134 | Q-P | HCL | 0.105199237 | 0.057452451 |
| 794 | K-T | NCL | 0.105199237 | 0.0553.44005 |
| 532 | — | INYFK (SEQ ID NO: 3978) | 0.105199237 | 0.091675146 |
| 558 | VI | AV | 0.105199237 | 0.093989814 |
| 610 | — | LA | 0.105199237 | 0.085523633 |
| 82 | -H | DS | 0.105199237 | 0.045790293 |
| 780 | DW | AV | 0.105199237 | 0.092887336 |
| 708 | — | KEVEQR (SEQ ID NO: 3990) | 0.105052225 | 0.060231645 |
| 548 | EAFE (SEQ ID NO: 3803) | RPSR (SEQ ID NO: 4132) | 0.105052225 | 0.087924295 |
| 251 | — | QKVIK (SEQ ID NO: 4106) | 0.105052225 | 0.044504449 |
| 497 | EA | AV | 0.105052225 | 0.084527693 |
| 841 | — | GKELKVE (SEQ ID NO: 3944) | 0.105052225 | 0.091417746 |
| 575 | F- | LS | 0.105052225 | 0.076582865 |
| 910 | — | VCLNC (SEQ ID NO: 4202) | 0.105052225 | 0.090851749 |
| 570 | — | EVNEN (SEQ ID NO: 3921) | 0.104207678 | 0.100821855 |
| 661 | — | EN | 0.104134797 | 0.102286534 |
| 500 | — | NSI | 0.104134797 | 0.058937244 |
| 420 | — | AWERIDK (SEQ ID NO: 3870) | 0.104134797 | 0.06870659 |
| 533 | — | NYFK (SEQ ID NO: 4082) | 0.104134797 | 0.074535749 |
| 747 | — | TQD | 0.104134797 | 0.072847901 |
| 371 | — | YK | 0.10.4134797 | 0.087850723 |
| 625 | TR | -Q | 0.104134797 | 0.077810682 |
| 195 | — | FY | 0.104134797 | 0.074775738 |
| 464 | — | IE | 0.103802674 | 0.096071807 |
| 451 | A | T | 0.103708002 | 0.093659384 |
| 245 | DII | ETV | 0.10291048 | 0.070762893 |
| 504 | — | DISG (SEQ ID NO: 3887) | 0.10291048 | 0.066659076 |
| 323 | -Q | IH | 0.10291048 | 0.071312882 |
| 638 | — | FERRE (SEQ ID NO: 3923) | 0.10291048 | 0.096842919 |
| 593 | — | REFIWNDLL (SEQ ID NO: 4121) | 0.10291048 | 0.079136445 |
| 730 | — | ADDMVR (SEQ ID NO: 3845) | 0.10291048 | 0.102673345 |
| 827 | KL | TV | 0.10291048 | 0.094773598 |
| 138 | VY | C- | 0.10291048 | 0.091363063 |
| 310 | QK | DR | 0.10291048 | 0.068590108 |
| 524 | KKL | RN[stop] | 0.102360708 | 0.063041226 |
| 940 | — | YKKYQ (SEQ ID NO: 4263) | 0.102324952 | 0.078047936 |
| 918 | — | THA | 0.102324952 | 0.066375654 |
| 979 | LE[stop]GSPG (SEQ ID NO: 3668) | VSSNDLQ (SEQ ID NO: 4245) | 0.102324952 | 0.073267994 |
| 4 | K | Q. | 0.101594625 | 0.098660596 |
| 589 | — | KRQGR (SEQ ID NO: 4019) | 0.101233118 | 0.096410486 |
| 211 | — | LEQIG (SEQ ID NO: 4031) | 0.101233118 | 0.097193308 |

TABLE 6-continued

| Fold enrichment of CasX DME Variants | | | | |
|---|---|---|---|---|
| Pos. | Ref. | Alt. | Med. Enrich. | 95% CI |
| 649 | I | N | 0.101148579 | 0.091521137 |
| 285 | — | HTKEGIE (SEQ ID NO: 3967) | 0.10063092 | 0.059060467 |
| 347 | — | VCN | 0.10063092 | 0.070834064 |
| 671 | — | D | 0.10063092 | 0 070617109 |
| 103 | AP | DS | 0.10063092 | 0.044259819 |
| 584 | — | PLA | 0.10063092 | 0.096095285 |
| 685 | GN | DS | 0.10063092 | 0.057986016 |
| 837 | — | TTINGKE (SEQ ID NO: 4197) | 0.10063092 | 0 070942034 |
| 509 | — | SKQY (SEQ ID NO: 4162) | 0.10063092 | 0 078527136 |
| 914 | -C | LS | 0.10063092 | 0.094652044 |
| 932 | — | WLF | 0.10063092 | 0.060195605 |
| 979 | LE[stop]G | VSRK (SEQ ID NO: 4222) | 0.10063092 | 0.052097814 |
| 194 | — | DFYSIH (SEQ ID NO: 3885) | 0.10063092 | 0.073983623 |
| 596 | — | IWND (SEQ ID NO: 3983) | 0.10063092 | 0.075782386 |
| 32 | L | S | 0.099998377 | 0.098160777 |
| 822 | D | E | 0.099951571 | 0.083423411 |
| 957 | F | S | 0.099918571 | 0.054364404 |
| 902 | — | HRPV (SEQ ID NO: 3964) | 0.099764722 | 0.080515888 |
| 474 | — | EFCRC (SEQ ID NO: 3909) | 0.099764722 | 0.089224756 |
| 242 | — | KYQ | 0.099764722 | 0.054563676 |
| 342 | D | C | 0.099764722 | 0.075335971 |
| 413 | — | WG | 0.099764722 | 0.079591734 |
| 149 | — | KPHTNYF (SEQ ID NO: 4013) | 0.099764722 | 0.070518497 |
| 510 | KQY | SHL | 0.099764722 | 0.087972807 |
| 220 | — | ASGPVG (SEQ ID NO: 3863) | 0.099764722 | 0.05025267 |
| 787 | AYEG (SEQ ID NO: 3801) | PTRD (SEQ ID NO: 4097) | 0.099764722 | 0.069079749 |
| 888 | — | RSGEA (SEQ ID NO: 4139) | 0.099764722 | 0.094243718 |
| 504 | — | DISGFS (SEQ ID NO: 3888) | 0.099764722 | 0.091750112 |
| 323 | QR | RD | 0.099764722 | 0.040967673 |
| 647 | SN | DS | 0.099764722 | 0.071118435 |
| 740 | DLLY (SEQ ID NO: 3802) | SAV- | 0.099753827 | 0.050146089 |
| 38 | — | A | 0.099114744 | 0.090540757 |
| 261 | LA | PV | 0.099083678 | 0.060781559 |
| 255 | — | KKNE (SEQ ID NO: 4000) | 0.098543421 | 0.07624083 |
| 280 | — | LPPQ (SEQ ID NO: 4051) | 0.098543421 | 0.069822078 |
| 308 | LW | PV | 0.097993366 | 0.087176639 |
| 753 | — | IFA | 0.097806547 | 0.045793305 |
| 205 | N | 1 | 0.097706358 | 0.075812724 |
| 142 | E | Q | 0.097553503 | 0.074603349 |
| 717 | — | GYSRKYAS (SEQ ID NO: 3961) | 0.097097924 | 0.054767341 |
| 979 | LE[stop]GSPG (SEQ ID NO: 3668) | VSSKDLH (SEQ ID NO: 4229) | 0.097097924 | 0.068112769 |
| 527 | NLYL (SEQ ID NO: 3828) | TCT[stop] | 0.097097924 | 0.089930288 |
| 230 | D | T | 0.097097924 | 0.061172404 |
| 595 | — | FIWN (SEQ ID NO: 3926) | 0.097097924 | 0.075559339 |
| 526 | LN | PV | 0.097097924 | 0.065035268 |
| 775 | — | YTRM (SEQ ID NO: 4270) | 0.097097924 | 0.054287911 |
| 607 | — | SL | 0.097097924 | 0.071187897 |
| 897 | -K | TE | 0.097097924 | 0.05492748 |
| 118 | GN | DS | 0.097097924 | 0.083309653 |
| 425 | D | V | 0.096834118 | 0.093228512 |
| 704 | — | IQ | 0.096824625 | 0.053400496 |
| 207 | — | PVKPLE (SEQ ID NO: 4098) | 0.096824625 | 0.074740089 |
| 154 | — | YF | 0.096824625 | 0.067984555 |

TABLE 6-continued

Fold enrichment of CasX DME Variants

| Pos. | Ref. | Alt. | Med. Enrich. | 95% CI |
|---|---|---|---|---|
| 668 | — | ALTD (SEQ ID NO: 3857) | 0.096824625 | 0.088221952 |
| 386 | — | DR | 0.096824625 | 0.067625309 |
| 388 | — | KKGK (SEQ ID NO: 3994) | 0.096824625 | 0.060426936 |
| 880 | — | DISS (SEQ ID NO: 3889) | 0.096824625 | 0.089590245 |
| 783 | — | TAKLAYEG (SEQ ID NO: 4180) | 0.096824625 | 0.064829377 |
| 643 | — | VLDSSNIK (SEQ ID NO: 4213) | 0.096824625 | 0.089286037 |
| 157 | — | RCN | 0.096824625 | 0.095145301 |
| 576 | — | DDPNLII (SEQ ID NO: 3877) | 0.096824625 | 0.040738988 |
| 296 | — | VVAQI (SEQ ID NO: 4250) | 0.096824625 | 0.081486595 |
| 559 | -I | CL | 0.096824625 | 0.07248553 |
| 979 | LE-[stop] | VSIK (SEQ ID NO: 4220) | 0.096824625 | 0.050151323 |
| 767 | — | RTFMAE (SEQ ID NO: 4144) | 0.096824625 | 0.057097889 |
| 928 | IA | TV | 0.096824625 | 0.059262285 |
| 694 | — | GES | 0.096824625 | 0.04858003 |
| 190 | — | QRA | 0.096824625 | 0.080026424 |
| 601 | — | LSLETGS (SEQ ID NO: 4059) | 0.096824625 | 0.078527715 |
| 150 | — | PH | 0.096482996 | 0.069152449 |
| 307 | — | NLW | 0.096482996 | 0.053647152 |
| 808 | — | TCS | 0.096381808 | 0.086676449 |
| 687 | — | PTHILRI (SEQ ID NO: 4096) | 0.095815136 | 0.067505643 |
| 469 | | EAD | 0.095416799 | 0.081758814 |
| 181 | VTYS (SEQ ID NO: 3838) | SHTA (SEQ ID NO: 4159) | 0.095412022 | 0.081952005 |
| 814 | F | C | 0.095092296 | 0.090308339 |
| 389 | K | [stop] | 0.094408724 | 0.074513611 |
| 663 | I | C | 0.094255793 | 0.075689829 |
| 979 | L | I | 0.092483102 | 0.077877212 |
| 290 | I- | LS | 0.092483102 | 0.055600721 |
| 202 | R-E | SSSLASGL (SEQ ID NO: 4174)[stop] | 0.092483102 | 0.051559995 |
| 130 | S | I | 0.092259428 | 0.091849472 |
| 237 | A | V | 0.092157582 | 0.073154252 |
| 550 | F- | LS | 0.091736446 | 0.078399586 |
| 352 | — | KLI | 0.091736446 | 0.062601185 |
| 257 | — | NEKRLA (SEQ ID NO: 4071) | 0.091736446 | 0.074344692 |
| 978 | [stop]LE | QVS | 0.091736446 | 0.070305933 |
| 878 | NN | ET | 0.091736446 | 0.057372719 |
| 484 | -KWYGD (SEQ ID NO: 3821) | NSSLSA (SEQ ID NO: 4075) | 0.091736446 | 0.051261975 |
| 820 | — | DYDRVLE (SEQ ID NO: 3899) | 0.091736446 | 0.087280678 |
| 415 | KVY | Nr- | 0.091736446 | 0.087802292 |
| 674 | GCPL (SEQ ID NO: 3808) | DAh[stop] | 0.091736446 | 0.089744971 |
| 705 | QA | -C | 0.091.736446 | 0.071260814 |
| 307 | -N | TD | 0.091736446 | 0.071147866 |
| 370 | G - | AV | 0.091736446 | 0.05182414 |
| 954 | KRA | T-V | 0.091736446 | 0.081861067 |
| 326 | KGFPS (SEQ ID NO: 3815) | RASLA (SEQ ID NO: 4119) | 0.091644836 | 0.054125593 |
| 289 | GI | LS | 0.091644836 | 0.069499341 |
| 142 | -E | CL | 0.091644836 | 0.064151435 |
| 10 | RR | TG | 0.091644836 | 0.090788699 |
| 193 | LDFYSIFI (SEQ ID NO: 3823) | RTSTAST (SEQ ID NO: 4146) | 0.091277438 | 0.058446074 |
| 979 | LE[stop]GS-PGIK (SEQ ID NO: 3665)[stop] | VSIKDLQASNK (SEQ ID NO: 4221) | 0.091277438 | 0.055852497 |
| 590 | — | RQGRE (SEQ ID NO: 4135) | 0.091277438 | 0.07404543 |
| 308 | — | LWQ | 0.091277438 | 0.063930973 |
| 311 | — | KLIKIGRDEA (SEQ ID NO: 4003) | 0.091277438 | 0.090951045 |

TABLE 6-continued

Fold enrichment of CasX DME Variants

| Pos. | Ref. | Alt. | Med. Enrich. | 95% CI |
|---|---|---|---|---|
| 585 | — | LAFGKR (SEQ ID NO: 4023) | 0.091277438 | 0.057801256 |
| 466 | — | GLKEADK (SEQ ID NO: 3950) | 0.091277438 | 0.064806465 |
| 414 | — | GK | 0.089604136 | 0.067494445 |
| 796 | — | YL | 0.08954136 | 0.077067905 |
| 872 | — | LSE | 0.089427419 | 0.072631533 |
| 388 | — | KKGKK (SEQ ID NO: 3995) | 0.089427419 | 0.050485092 |
| 211 | LEQIGG (SEQ ID NO: 3826) | RNRSAA (SEQ ID NO: 4128) | 0.089427419 | 0.058037112 |
| 193 | LDFYSIHV (SEQ ID NO: 3824) | RTSTAST (SEQ ID NO: 4147)[stop] | 0.089427419 | 0.06189365 |
| 769 | FMAERQY (SEQ ID NO: 3806) | LWPRGSI (SEQ ID NO: 4062) | 0.089427419 | 0.048645432 |
| 558 | — | VIN | 0.089427419 | 0.08506841 |
| 973 | — | WKP | 0.089427419 | 0.059845159 |
| 285 | — | HTKE (SEQ ID NO: 3965) | 0.089427419 | 0.058488636 |
| 353 | — | LI | 0.089427419 | 0.055053978 |
| 950 | — | GNTD (SEQ ID NO: 3952) | 0.089427419 | 0.068410765 |
| 642 | — | EVLDS (SEQ ID NO: 3920) | 0.089427352 | 0.04064403 |
| 586 | AE | FT | 0.089427352 | 0.026351335 |
| 147 | KG | C- | 0.089427352 | 0.03353623 |
| 473 | — | DEFCR (SEQ ID NO: 3881) | 0.089427352 | 0.087380064 |
| 62 | SR | CL | 0.089427352 | 0.085389222 |
| 946 | N | C | 0.089127352 | 0.086906423 |
| 341 | — | VDWWD (SEQ ID NO: 4204) | 0.089427352 | 0.088291312 |
| 546 | — | KPE | 0.089427352 | 0.070048864 |
| 979 | LE[stop]G-SPGI (SEQ ID NO: 3674) | VSSKDLQACL (SEQ ID NO: 4231) | 0.089062173 | 0.059857989 |
| 979 | LE[stop]GSPG (SEQ ID NO: 3668) | ISSKDLQ (SEQ ID NO: 3980) | 0.089062173 | 0.071078934 |
| 300 | — | IVIW | 0.089062173 | 0.052509601 |
| 209 | KP | TV | 0.089062173 | 0.046404323 |
| 851 | -T | CL | 0.089062173 | 0.047830666 |
| 466 | GL | LS | 0.089062173 | 0.060367604 |
| 202 | RE- | SSSL (SEQ ID NO: 4173) | 0.089062173 | 0.059904595 |
| 291 | EA | DC | 0.089062173 | 0.078319771 |
| 871 | RL | LS | 0.089062173 | 0.055570451 |
| 874 | EE | DR | 0.089062173 | 0.077193595 |
| 868 | ELDR (SEQ ID NO: 3805) | NWT- | 0.089062173 | 0.059312334 |
| 301 | VI | AV | 0.089062173 | 0.083633904 |
| 208 | — | VKPLEQI (SEQ ID NO: 4212) | 0.089062173 | 0.046331388 |
| 305 | -N | TT | 0.089062173 | 0.072049193 |
| 978 | [stop]L | GP | 0.089062173 | 0.071277586 |
| 866 | S- | TG | 0.089062173 | 0.056416779 |
| 628 | DE | LS | 0.089062173 | 0.070268313 |
| 651 | -P | TA | 0.089062173 | 0.05500823 |
| 276 | — | PKI | 0.089062173 | 0.06318371 |
| 299 | — | V | 0.089062173 | 0.08531757 |
| 346 | — | MV | 0.089062173 | 0.060831249 |
| 742 | LY | PV | 0.089062173 | 0.087665343 |
| 743 | YY | ET | 0.089062173 | 0.059923968 |
| 751 | ML | RQ | 0.089062173 | 0.045208162 |
| 894 | -S | RQ | 0.089062173 | 0.071980752 |
| 433 | KH | TV | 0.089062173 | 0.061328218 |
| 899 | RF | LS | 0.089062173 | 0.083069213 |
| 582 | — | ILP | 0.089062173 | 0.053169618 |
| 944 | — | QTN | 0.089062173 | 0.066135158 |
| 170 | SP | RQ | 0.089062173 | 0.059574685 |
| 771 | — | AERQY (SEQ ID NO: 3847) | 0.089062173 | 0.079591468 |
| 808 | TC | DS | 0.089062173 | 0.069853908 |
| 347 | — | VC | 0.089062173 | 0.085265549 |
| 554 | RF | SC | 0.089062173 | 0.05713278 |
| 419 | EA | LS | 0.089062173 | 0.062902243 |

TABLE 6-continued

Fold enrichment of CasX DME Variants

| Pos. | Ref. | Alt. | Med. Enrich. | 95% CI |
|---|---|---|---|---|
| 184 | — | SLGKEG (SEQ ID NO: 4164) | 0.089062173 | 0.066443269 |
| 417 | — | YDEAWE (SEQ ID NO: 4260) | 0.089062173 | 0.084599468 |
| 911 | CL | DR | 0.089062173 | 0.07167912 |
| 735 | — | RNTARDLLY (SEQ ID NO: 4130) | 0.089062173 | 0.058412514 |
| 305 | N | D | 0.089057834 | 0.075458081 |
| 886 | KGR | RAD | 0.08869535 | 0.056741957 |
| 235 | A | P | 0.088591922 | 0.085721293 |
| 494 | — | FAIEAEN (SEQ ID NO: 3922) | 0.088487772 | 0.046582849 |
| 957 | F | Y | 0.088355066 | 0.088244344 |
| 670 | — | TDPEG (SEQ ID NO: 4184) | 0.087352311 | 0.070989739 |
| 388 | — | KK | 0.087352311 | 0.077174067 |
| 294 | — | NN | 0.087352311 | 0.079627552 |
| 748 | — | QDAIMLI (SEQ ID NO: 4099) | 0.087352311 | 0.070738039 |
| 978 | [stop]LE[stop]G | SVSSK (SEQ ID NO: 4177) | 0.087252372 | 0.078631278 |
| 979 | LE[stop]GS-PGIK (SEQ ID NO: 3665) | VSSKDLHASN (SEQ ID NO: 4230) | 0.087252372 | 0.071793737 |
| 735 | — | RNTARD (SEQ ID NO: 4129) | 0.087252372 | 0.052948743 |
| 227 | — | ALSDACM (SEQ ID NO: 3856) | 0.087252372 | 0.073258454 |
| 151 | HTNYFGRCNV (SEQ ID NO: 3812) | TPTTSADATC (SEQ ID NO: 4193) | 0.087252372 | 0.05854259 |
| 875 | — | ESVNND (SEQ ID NO: 3918) | 0.087252372 | 0.069839022 |
| 151 | -H | CL | 0.087252372 | 0.072166234 |
| 517 | — | IWQKD (SEQ ID NO: 3985) | 0.087252372 | 0.059389612 |
| 294 | NN | ET | 0.087252372 | 0.054113615 |
| 979 | LE[stop]GS-PGIK (SEQ ID NO: 3665)[stop] | VSSEDLQASNK (SEQ ID NO: 4224) | 0.087252372 | 0.053550045 |
| 280 | LP | C- | 0.087252372 | 0.046361662 |
| 973 | WK | CL | 0.087252372 | 0.043130788 |
| 859 | — | Q | 0.087252372 | 0.049734005 |
| 383 | — | SEEDR (SEQ ID NO: 4148) | 0.087252372 | 0.079531899 |
| 193 | — | LDFYSIHVT (SEQ ID NO: 4029) | 0.087252372 | 0.075700876 |
| 731 | — | DDMV (SEQ ID NO: 3876) | 0.087252372 | 0.055852115 |
| 586 | — | AFG | 0.087252372 | 0.059593552 |
| 743 | — | YYAVTQ (SEQ ID NO: 3799) | 0.087252372 | 0.074424467 |
| 90 | KDP | NCL | 0.087252372 | 0.062483354 |
| 459 | — | KAS | 0.087252372 | 0.077679223 |
| 319 | — | AKPLQRLK (SEQ ID NO: 3853) | 0.087252372 | 0.077741662 |
| 844 | — | LKVEGQI (SEQ ID NO: 4043) | 0.087252372 | 0.078010123 |
| 964 | — | FYRKK (SEQ ID NO: 3935) | 0.087252372 | 0.061717189 |
| 510 | — | KQYNC (SEQ ID NO: 4016) | 0.087252372 | 0.072460113 |
| 211 | LE | C- | 0.087252372 | 0.072615166 |
| 154 | — | YFG | 0.087252372 | 0.050562832 |
| 428 | — | V | 0.087252372 | 0.070602271 |
| 328 | — | FPSFPLV (SEQ ID NO: 3928) | 0.087252372 | 0.050986167 |
| 334 | — | VER | 0.087252372 | 0.083245674 |
| 635 | — | ALT | 0.087252372 | 0.058640453 |
| 87 | EF | DC | 0.087252372 | 0.084662756 |
| 763 | — | RQGK (SEQ ID NO: 4134) | 0.087252372 | 0.06272177 |
| 525 | — | KLNL (SEQ ID NO: 4005) | 0.087252372 | 0.087055601 |
| 482 | LQK | PLM | 0.087252372 | 0.0864173 |
| 228 | — | LS | 0.087252372 | 0.071648918 |

TABLE 6-continued

| Fold enrichment of CasX DME Variants | | | | |
|---|---|---|---|---|
| Pos. | Ref. | Alt. | Med. Enrich. | 95% CI |
| 149 | — | KPHT (SEQ ID NO: 4011) | 0.087252372 | 0.063809398 |
| 14 | VKDSNTK (SEQ ID NO: 3837) | SRTATOR (SEQ ID NO: 4172) | 0.087252372 | 0.086609324 |
| 567 | VP | C- | 0.087252372 | 0.05902513 |
| 11 | RR | GD | 0.087252372 | 0.07840862 |
| 979 | LE[stop]G | VPSK (SEQ ID NO: 4215) | 0.086010969 | 0.05573546 |
| 671 | D | V | 0.084756133 | 0.072837893 |
| 462 | — | FVI | 0.083590457 | 0.068208408 |
| 619 | TLYNRRTR (SEQ ID NO: 3835) | PCTTGEPD (SEQ ID NO: 4086) | 0.083590457 | 0.071170573 |
| 337 | QA | PV | 0.083590457 | 0.078536227 |
| 418 | — | DEAW (SEQ ID NO: 3878) | 0.083590457 | 0.038813523 |
| 426 | — | KK | 0.083590457 | 0.07413354 |
| 208 | VK | AV | 0.083590457 | 0.037512118 |
| 519 | — | QK | 0.083590457 | 0.082570582 |
| 122 | LI | D[stop] | 0.083590457 | 0.076976074 |
| 659 | RG | PV | 0.083590457 | 0.0659041 |
| 160 | — | VSEHERL (SEQ ID NO: 4218) | 0.083590457 | 0.081613302 |
| 278 | IT | TA | 0.083590457 | 0.047460329 |
| 242 | KY | CL | 0.083590457 | 0.045794039 |
| 518 | WQ | GR | 0.08340916 | 0.072293259 |
| 513 | — | NCAF (SEQ ID NO: 4067) | 0.08340916 | 0.058923148 |
| 31 | L | C | 0.082126328 | 0.081561344 |
| 868 | E | G | 0.081974564 | 0.070868354 |
| 681 | — | KDSLG (SEQ ID NO: 3986) | 0.080796062 | 0.070617083 |
| 552 | — | AN | 0.080796062 | 0.080329675 |
| 168 | — | LLS | 0.080796062 | 0.076933587 |
| 418 | — | DEAVVERID (SEQ ID NO: 3880) | 0.080796062 | 0.062400841 |
| 356 | — | EKKED (SEQ ID NO: 3914) | 0.080428937 | 0.076250147 |
| 275 | — | FP | 0.080428937 | 0.059363481 |
| 308 | — | LVVQKLK (SEQ ID NO: 4063) | 0.080428937 | 0.078547724 |
| 15 | KDSNTKK (SEQ ID NO: 3814) | RTATQRR (SEQ ID NO: 4142) | 0.080428937 | 0.072523813 |
| 979 | LE[stop]GSPGI (SEQ ID NO: 3674) | VSSKDLQG (SEQ ID NO: 4235) | 0.080428937 | 0.070440346 |
| 425 | — | DKK | 0.080428937 | 0.056582403 |
| 288 | EGI | RAS | 0.080428937 | 0.054809688 |
| 849 | QI | R- | 0.080428937 | 0.058314054 |
| 526 | — | LNLYL (SEQ ID NO 4048) | 0.080428937 | 0.073029285 |
| 546 | — | KPEA (SEQ ID NO: 4010) | 0.080428937 | 0.06983999 |
| 792 | — | PS | 0.080428937 | 0.067496853 |
| 706 | — | AAKEVEQR (SEQ ID NO: 3843) | 0.080428937 | 0.075434091 |
| 710 | — | VEQR (SEQ ID NO: 4206) | 0.080165897 | 0.064037522 |
| 949 | -T | LS | 0.080165897 | 0.057028434 |
| 224 | V | C | 0.080165897 | 0.062705318 |
| 202 | — | RESNH (SEQ ID NO: 4122) | 0.08002463 | 0.069004172 |
| 380 | YLS | -T[stop] | 0.079267535 | 0.078743084 |
| 617 | — | EKT | 0.079267535 | 0.066283102 |
| 237 | AS | TA | 0.079267535 | 0.061120875 |
| 416 | VYD | C-T | 0.07889536 | 0.067603097 |
| 554 | — | RFYIVINKK (SEQ ID NO: 4124) | 0.078495111 | 0.06923226 |
| 619 | TLYN (SEQ ID NO: 3834) | PC-T | 0.078181072 | 0.043873495 |
| 904 | — | PV | 0.077521024 | 0.061782081 |
| 8 | KR | ETG | 0.075979618 | 0.06718831 |
| 963 | — | SF-YR (SEQ ID NO: 4152) | 0.075979618 | 0.064323698 |
| 34 | RV | SC | 0.075979618 | 0.063118319 |
| 369 | — | AGYKRQ (SEQ ID NO: 3851) | 0.075979618 | 0.050848396 |

TABLE 6-continued

Fold enrichment of CasX DME Variants

| Pos. | Ref. | Alt. | Med. Enrich. | 95% CI |
|---|---|---|---|---|
| 242 | KY | TV | 0.075979618 | 0.056127246 |
| 297 | VAQIV (SEQ ID NO: 3836) | WPRS (SEQ ID NO: 4256)[stop] | 0.075979618 | 0.07433917 |
| 672 | -P | LS | 0.075979618 | 0.056690099 |
| 650 | KP | TV | 0.075979618 | 0.062837656 |
| 454 | DW | AV | 0.075979618 | 0.049282705 |
| 312 | LK | PV | 0.075979618 | 0.074673373 |
| 636 | LT | PV | 0.075651042 | 0.051037357 |
| 325 | — | LKGFP (SEQ ID NO: 4042) | 0.075651042 | 0.068819815 |
| 669 | L | E | 0.075651042 | 0.075396635 |
| 79 | A | V | 0.074780904 | 0.074608034 |
| 887 | — | GRSGEA (SEQ ID NO: 3956) | 0.073542892 | 0.072424639 |
| 404 | HL | DR | 0.073542892 | 0.054184233 |
| 190 | Q-R | HVA | 0.073542892 | 0.04828771 |
| 811 | NC | DS | 0.073542892 | 0.073088889 |
| 824 | — | VLEK (SEQ ID NO: 4214) | 0.073542892 | 0.055393108 |
| 63 | RA | TV | 0.073542892 | 0.069467367 |
| 350 | VK | AV | 0.072378636 | 0.048322939 |
| 690 | ILRI (SEQ ID NO: 3813) | PEN- | 0.072378636 | 0.05860973 |
| 384 | EED | D-C | 0.072378636 | 0.064425519 |
| 487 | — | GDLRGKP (SEQ ID NO: 3942) | 0.072378636 | 0.071208648 |
| 644 | L | [stop] | 0.072378636 | 0.060246346 |
| 544 | KI | TV | 0.072378636 | 0.05442277 |
| 933 | — | LFLR (SEQ ID NO: 4032) | 0.072378636 | 0.06374014 |
| 276 | PKITLP (SEQ ID NO: 3829) | LRSPCL (SEQ ID NO: 4054) | 0.072378636 | 0.070970251 |
| 808 | — | TCSNCGET (SEQ ID NO: 4183) | 0.072378636 | 0.065622369 |
| 978 | [stop]LE[stop]GS- | YVSSKDL (SEQ ID NO: 4275) | 0.072378636 | 0.066035046 |
| 919 | HA | PV | 0.072378636 | 0.058676376 |
| 378 | — | LPYLSSE (SEQ ID NO: 4053) | 0.072378636 | 0.071574474 |
| 858 | RQ | LS | 0.072378636 | 0.04290216 |
| 152 | — | TNYFGRCN (SEQ ID NO: 4192) | 0.072378636 | 0.054241402 |
| 859 | — | QNVVKD (SEQ ID NO: 4108) | 0.072378636 | 0.069366552 |
| 226 | KA | LS | 0.071324732 | 0.06748566 |
| 849 | — | QITYYN (SEQ ID NO: 4105) | 0.071251281 | 0.061753986 |
| 376 | — | ALLP (SEQ ID NO: 3854) | 0.071251281 | 0.046839434 |
| 660 | — | GEN | 0.071251281 | 0.063597301 |
| 349 | — | NVKKLIN (SEQ ID NO: 4079) | 0.071251281 | 0.055420168 |
| 427 | KVE | NCL | 0.071251281 | 0.037488341 |
| 537 | GGKLRFK (SEQ ID NO: 3809) | AASCGSR (SEQ ID NO: 3844) | 0.071251281 | 0.047685675 |
| 486 | — | YGDLR (SEQ ID NO: 4262) | 0.071251281 | 0.057530117 |
| 586 | — | AFGKRQG (SEQ ID NO: 3850) | 0.071251281 | 0.055531139 |
| 850 | — | ITYY (SEQ ID NO: 3981) | 0.071251281 | 0.070061657 |
| 929 | — | ARS | 0.071251281 | 0.070844259 |
| 617 | EK | AV | 0.071251281 | 0.056273969 |
| 977 | V[stop] | AV | 0.071036023 | 0.057250091 |
| 522 | — | GVK | 0.071036023 | 0.066325629 |
| 903 | RP | LS | 0.070891186 | 0.042147704 |
| 689 | HI | P- | 0.070270828 | 0.063050321 |
| 663 | — | I | 0.070270828 | 0.06150934 |
| 649 | IK | RQ | 0.070270828 | 0.060617973 |
| 258 | — | EK | 0.070270828 | 0.058125711 |
| 152 | TN | DS | 0.070270828 | 0.059660679 |
| 351 | — | KKLINE (SEQ ID NO: 3998) | 0.070270828 | 0.061736597 |
| 763 | — | RQ | 0.070270828 | 0.05541295 |
| 666 | VI | DS | 0.070270828 | 0.069953364 |
| 186 | GK | RQ | 0.066783091 | 0.059043838 |

TABLE 6-continued

Fold enrichment of CasX DME Variants

| Pos. | Ref. | Alt. | Med. Enrich. | 95% CI |
|---|---|---|---|---|
| 242 | — | KYQDIILE (SEQ ID NO: 4022) | 0.066783091 | 0.058248788 |
| 190 | — | QRALDFYS (SEQ ID NO: 4110) | 0.066783091 | 0.060436783 |
| 615 | VI | DS | 0.066783091 | 0.065544343 |
| 295 | — | NVVAQI (SEQ ID NO: 4081) | 0.066783091 | 0.066726619 |
| 549 | AFE | PTR | 0.066783091 | 0.063271062 |
| 924 | -AL | PSG | 0.066783091 | 0.057049314 |
| 979 | LE[stop] | VSR | 0.06547263 | 0.059545386 |
| 284 | P | L | 0.06489326 | 0.063807972 |
| 620 | — | LY | 0.06268189 | 0.052769076 |
| 668 | -A | LS | 0.06268489 | 0.057930418 |
| 651 | — | PMNL (SEQ ID NO: 4091) | 0.06268489 | 0.054376534 |
| 723 | -SK | PPLL (SEQ ID NO: 4093) | 0.061911903 | 0.057719078 |
| 788 | YEG | TRD | 0.061911903 | 0.061258021 |
| 572 | NE | DS | 0.061911903 | 0.059419672 |
| 943 | — | YQTN (SEQ ID NO: 4269) | 0.061911903 | 0.05179175 |
| 979 | LE[stop]GS-P | VSSKDVQ (SEQ ID NO: 4240) | 0.061911903 | 0.05324798 |
| 49 | KK | RS | 0.061911903 | 0.057783548 |
| 745 | -A | LS | 0.061911903 | 0.055420231 |
| 262 | -AN | ETD | 0.061911903 | 0.056977155 |
| 726 | — | AKNL (SEQ ID NO: 3852) | 0.061911903 | 0.05965082 |
| 583 | — | LPLA (SEQ ID NO: 4050) | 0.061911903 | 0.053222838 |
| 585 | — | LA | 0.061911903 | 0.047677961 |
| 347 | — | VCNVKKLI (SEQ ID NO: 4203) | 0.061911903 | 0.060561898 |
| 735 | RN | Q- | 0.061911903 | 0.057911259 |
| 176 | AN | TD | 0.061911903 | 0.042711394 |
| 484 | -KWYGDL (SEQ ID NO: 3822) | NSSLSASF (SEQ ID NO: 4077) | 0.061911903 | 0.060235262 |
| 416 | VY | CT | 0.061911903 | 0.058375882 |
| 900 | FS | SV | 0.060850202 | 0.045333847 |
| 550 | FE | CL | 0.060850202 | 0.050669807 |
| 169 | LS | -P | 0.059253838 | 0.055169203 |
| 487 | GD | CL | 0.058561444 | 0.050771143 |
| 800 | — | TLAQYT (SEQ ID NO: 4190) | 0.058239485 | 0.054115265 |
| 863 | KD | RI | 0.058239485 | 0.041340026 |
| 407 | KKHGE (SEQ ID NO: 3816) | RSTAR (SEQ ID NO: 4141) | 0.058239485 | 0.049050481 |
| 593 | — | REFIW (SEQ ID NO: 4120) | 0.058239485 | 0.057097188 |
| 979 | LE[stop]G-SP | VSSKVLQ (SEQ ID NO: 4241) | 0.050653241 | 0.049828056 |
| 42 | ER | A- | 0.050653241 | 0.043693463 |
| 897 | — | KK | 0.050653241 | 0.046680114 |
| 294 | NN | DS | 0.049177787 | 0.048944158 |
| 186 | GKEGQRALDFY (SEQ ID NO: 3810) | ASSDREPWTST (SEQ ID NO: 3864) | 0.049177787 | 0.048777834 |
| 696 | SYK | -LQ | 0.049177787 | 0.048584657 |
| 552 | AN | DS | 0.049177787 | 0.044744659 |
| 979 | LE[stop]G-SPGIK (SEQ ID NO: 3665)[stop] (SEQ ID NO: 3665) | VSSKYLQASNK (SEQ ID NO: 4242) | 0.049086177 | 0.048688856 |
| 413 | — | WGKVYDEA (SEQ ID NO: 4253) | 0.048681821 | 0.046101055 |
| 920 | — | AAEQA (SEQ ID NO: 3842) | 0.048224673 | 0.046055533 |
| 979 | LE[stop]GSPG (SEQ ID NO: 3668) | VSSKDFQ (SEQ ID NO: 4226) | 0.047884408 | 0.043419619 |
| 423 | RIDKKV (SEQ ID NO: 3830) | -NRQ | 0.046868759 | 0.045505043 |

TABLE 6-continued

| Fold enrichment of CasX DME Variants | | | | |
|---|---|---|---|---|
| Pos. | Ref. | Alt. | Med. Enrich. | 95% CI |
| 162 | EH | AV | 0.043166861 | 0.040108447 |
| 741 | LLY | CC- | 0.041101883 | 0.039741701 |
| 443 | SEDAQS (SEQ ID NO: 3831) | RGRP (SEQ ID NO: 4125)\|[stop] | 0.041101883 | 0.03770041 |
| 767 | RT | TA | 0.041101883 | 0.040956261 |

In Table 6, [stop] represent a stop codon, so that amino acids that follow are additional amino acids after a stop codon. (-) holds the position for the insertion shown in the adjacent "Alteration" column. Pos.: Position; Ref.: Reference; Alt.: Alternation; Med. Enrich.: Median Enrichment.

Example 5: Cleavage Activity of Selected CasX Protein Variants and Variant Protein:sgRNA Pairs The effect of select CasX protein variants on CasX protein activity, using a reference sgRNA scaffold (SEQ ID NO: 5) and E6 and/or E7 spacers is shown in Table 7 below and FIGS. 10 and 11.

In brief, EGFP HEK293T reporter cells were seeded into 96-well plates and transfected according to the manufacturer's protocol with Lipofectamine™ 3000 (Life Technologies) and 100-200 ng plasmid DNA encoding the variant CasX protein, P2A-puromycin fusion and the reference sgRNA. The next day cells were selected with 1.5 µg/ml puromycin for 2 days and analyzed by fluorescence-activated cell sorting 7 days after selection to allow for clearance of EGFP protein from the cells EGFP disruption via editing was traced using an Attune NxT Flow Cytometer and high-throughput autosampler.

TABLE 7

Effect of CasX Protein Variants. These mutations are relative to SEQ ID NO: 2.

| Normalized Editing Activity | Standard Deviation | Mutation Descriptor | SEQ ID NO |
|---|---|---|---|
| 3.56 | 0.479918161 | L379R + C477K + A708K + [P793] + T620P | 3301 |
| 3.44 | 0.065473567 | M771A | 3302 |
| 3.25 | 0.243066966 | L379R + A708K + [P793] + D732N | 3303 |
| 3.2 | 0.065443719 | W782Q | 3304 |
| 3.08 | 0.06581193 | M771Q | 3305 |
| 3.06 | 0.098482124 | R458I + A739V | 3306 |
| 2.99 | 0.249667198 | L379R + A708K + [P793] + M771N | 3307 |
| 2.98 | 0.226829483 | L379R + A708K + [P793] + A739T | 3308 |
| 2.98 | 0.230093698 | L379R + C477K + A708K + [P793] + D489S | 3309 |
| 2.95 | 0.225022742 | L379R + C477K + A708K + [P793] + D732N | 3310 |
| 2.95 | 0.048047426 | V711K | 3311 |
| 2.85 | 0.244869555 | L379R + C477K + A708K + [P793] + Y797L | 3312 |
| 2.84 | 0.16661152 | L379R + A708K + [P793] | 3313 |
| 2.82 | 0.219742241 | L379R + C477K + A708K + [P793] + M771N | 3314 |
| 2.75 | 0.215673641 | A708K + [P793] + E386S | 3315 |
| 2.71 | 0.10301172 | L379R + C477K + A708K + [P793] | 3316 |
| 2.62 | 0.066259269 | L792D | 3317 |
| 2.61 | 0.069056066 | G791F | 3318 |
| 2.56 | 0.138158681 | A708K + [P793] + A739V | 3319 |
| 2.52 | 0.110846334 | L379R + A708K + [P793] + A739V | 3320 |
| 2.5 | 0.070762901 | C477K + A708K + [P793] | 3321 |
| 2.47 | 0.180431811 | L249I, M771N | 3322 |
| 2.46 | 0.050035486 | V747K | 3323 |
| 2.42 | 0.14702229 | L379R + C477K + A708K + [P793] + M779N | 3324 |
| 2.36 | 0.045498608 | F755M | 3325 |
| 2.3 | 0.179759799 | L379R + A708K + [P793] + G791M | 3326 |
| 2.29 | 0.16573206 | E386R + F399L + [P793] | 3327 |
| 2.24 | 0.000278715 | A708K + [P793] | 3328 |
| 2.23 | 0.243365847 | L404K | 3329 |
| 2.16 | 0.019745961 | E552A | 3330 |
| 2.13 | 0.002238075 | A708K | 3331 |
| 2.08 | 0.316339196 | M779N | 3332 |
| 2.08 | 0.062500445 | P793G | 3333 |
| 2.07 | 0.117354932 | L379R + C477K + A708K + [P793] + A739V | 3334 |
| 2.03 | 0.057771128 | L792K | 3335 |
| 2.01 | 0.186905281 | L379R + A708K + [P793] + M779N | 3336 |
| 2.01 | 0.080358848 | ^AS797 | 3337 |
| 1.95 | 0.218366091 | C477H | 3338 |
| 1.95 | 0.040076499 | Y857R | 3339 |
| 1.94 | 0.032799694 | L742W | 3340 |
| 1.94 | 0.038256856 | I658V | 3341 |
| 1.93 | 0.055533894 | C477K + A708K + [P793] + A739V | 3342 |
| 1.9 | 0.028572575 | S932M | 3343 |
| 1.84 | 0.115143156 | T620P | 3344 |

TABLE 7-continued

Effect of CasX Protein Variants. These mutations are relative to SEQ ID NO: 2.

| Normalized Editing Activity | Standard Deviation | Mutation Descriptor | SEQ ID NO |
|---|---|---|---|
| 1.81 | 0.18802403 | E385P | 3345 |
| 1.81 | 0.049828835 | A708Q | 3346 |
| 1.76 | 0.043121298 | L307K | 3347 |
| 1.7 | 0.03352434 | L379R + A708K + [P793] + D489S | 3348 |
| 1.7 | 0.170748704 | C477Q | 3349 |
| 1.65 | 0.051918988 | Q804A | 3350 |
| 1.64 | 0.169459451 | F399L | 3351 |
| 1.64 | 0.02984323 | L379R + A708K + [P793] + Y797L | 3352 |
| 1.64 | 0.168799771 | L379R + C477K + A708K + [P793] + G791M | 3353 |
| 1.63 | 0.035361733 | D733T | 3354 |
| 1.63 | 0.062042898 | P793Q | 3355 |
| 1.6 | 0.000928887 | A739V | 3356 |
| 1.59 | 0.208295832 | E386S | 3357 |
| 1.58 | 0.00189514 | F536S | 3358 |
| 1.57 | 0.204148363 | D387K | 3359 |
| 1.55 | 0.198137682 | E386N | 3360 |
| 1.52 | 0.000291529 | C477K | 3361 |
| 1.51 | 0.00032232 | C477R | 3362 |
| 1.49 | 0.095600844 | A739T | 3363 |
| 1.46 | 0.051799824 | S219R | 3364 |
| 1.41 | 0.000272809 | K416E & A708K | 3365 |
| 1.4 | 4.65E−05 | L379R | 3366 |
| 1.38 | 0.043395969 | E385K | 3367 |
| 1.36 | 0.000269797 | G695H | 3368 |
| 1.35 | 0.02584186 | L379R + C477K + A708K + [P793] + A739T | 3369 |
| 1.35 | 0.158192737 | E292R | 3370 |
| 1.34 | 0.184524879 | L792K | 3371 |
| 1.31 | 0.064556939 | K25R | 3372 |
| 1.31 | 0.08768015 | K975R | 3373 |
| 1.31 | 0.062237773 | V959M | 3374 |
| 1.29 | 0.092916832 | D489S | 3375 |
| 1.29 | 0.137197584 | K808S | 3376 |
| 1.28 | 0.181775511 | N952T | 3377 |
| 1.27 | 0.031730102 | K975Q | 3378 |
| 1.25 | 0.030353503 | S890R | 3379 |
| 1.23 | 0.350374014 | [P793] | 3380 |
| 1.21 | 8.61E−05 | A788W | 3381 |
| 1.21 | 0.057483618 | Q338R + A339E | 3382 |
| 1.21 | 0.116491085 | I7F | 3383 |
| 1.21 | 0.061416272 | QT945KI | 3384 |
| 1.21 | 0.091585825 | K682E | 3385 |
| 1.19 | 0.000423928 | E385A | 3386 |
| 1.19 | 0.053255444 | P793S | 3387 |
| 1.18 | 0.043774095 | E385Q | 3388 |
| 1.18 | 0.124987984 | D732N | 3389 |
| 1.17 | 0.101573595 | E292K | 3390 |
| 1.16 | 0.000245107 | S794R + Y797L | 3391 |
| 1.15 | 0.160445636 | G791M | 3392 |
| 1.14 | 0.098217225 | I303K | 3393 |
| 1.12 | 0.000275601 | ^AS793 | 3394 |
| 1.11 | 0.037923895 | S603G | 3395 |
| 1.08 | 6.48E−05 | Y797L | 3396 |
| 1.08 | 0.034990079 | A377K | 3397 |
| 1.08 | 0.059730153 | K955R | 3398 |
| 1.04 | 0.000376903 | T886K | 3399 |
| 1.03 | 0.036131932 | Q338R + A339K | 3400 |
| 1.03 | 0.031397109 | P283Q | 3401 |
| 1.01 | 0.000158685 | D600N | 3402 |
| 1.01 | 0.095937558 | S867R | 3403 |
| 1.01 | 0.079977243 | E466H | 3404 |
| 1 | 0.086320071 | E53K | 3405 |
| 0.98 | 0.123364563 | L792E | 3406 |
| 0.97 | 5.98E−05 | Q338R | 3407 |
| 0.96 | 0.059312097 | H152D | 3408 |
| 0.95 | 0.122246867 | V254G | 3409 |
| 0.94 | 0.072611815 | TT949PP | 3410 |
| 0.93 | 0.091846036 | I279F | 3411 |
| 0.93 | 0.031803852 | L897M | 3412 |
| 0.92 | 0.000288973 | K390R | 3413 |
| 0.91 | 0.000565042 | K390R | 3414 |
| 0.89 | 0.001316868 | L792G | 3415 |
| 0.89 | 0.000623156 | A739V | 3416 |
| 0.89 | 0.033874895 | R624G | 3417 |
| 0.88 | 0.103894502 | C349E | 3418 |

TABLE 7-continued

Effect of CasX Protein Variants. These mutations are relative to SEQ ID NO: 2.

| Normalized Editing Activity | Standard Deviation | Mutation Descriptor | SEQ ID NO |
|---|---|---|---|
| 0.86 | 0.11267313 | E498K | 3419 |
| 0.85 | 0.079415017 | R388Q | 3420 |
| 0.84 | 0.000115651 | I55F | 3421 |
| 0.84 | 0.000383356 | E712Q | 3422 |
| 0.83 | 0.025220431 | E475K | 3423 |
| 0.81 | 0.000172705 | ^AS796 | 3424 |
| 0.8 | 0.111675911 | Q628E | 3425 |
| 0.79 | 0.000114918 | C479A | 3426 |
| 0.79 | 0.001115871 | Q338E | 3427 |
| 0.78 | 0.000744903 | K25Q | 3428 |
| 0.76 | 0.000269223 | ^AS795 | 3429 |
| 0.74 | 0.000437653 | L481Q | 3430 |
| 0.73 | 0.0001773 | E552K | 3431 |
| 0.72 | 0.000298273 | T153I | 3432 |
| 0.69 | 0.000273628 | N880D | 3433 |
| 0.68 | 0.000192096 | G791M | 3434 |
| 0.67 | 0.000295463 | C233S | 3435 |
| 0.67 | 0.000123996 | Q367K + I425S | 3436 |
| 0.67 | 0.000188025 | L685I | 3437 |
| 0.66 | 0.000169478 | K942Q | 3438 |
| 0.66 | 0.000374718 | N47D | 3439 |
| 0.66 | 0.138212411 | V635M | 3440 |
| 0.64 | 0.067027049 | G27D | 3441 |
| 0.63 | 0.000195863 | C479L | 3442 |
| 0.63 | 0.000439659 | [P793] + P793AS | 3443 |
| 0.62 | 0.000211625 | T72S | 3444 |
| 0.62 | 0.000217614 | S270W | 3445 |
| 0.61 | 0.00019414 | A751S | 3446 |
| 0.6 | 0.066962306 | Q102R | 3447 |
| 0.57 | 0.052391074 | M734K | 3448 |
| 0.53 | 0.000621789 | ^AS795 | 3449 |
| 0.53 | 0.145184217 | F189Y | 3450 |
| 0.5 | 0.038258832 | W885R | 3451 |
| 0.48 | 0.000505099 | A636D | 3452 |
| 0.47 | 0.030480379 | K416E | 3453 |
| 0.46 | 0.428767546 | R693I | 3454 |
| 0.45 | 0.593145404 | m29R | 3455 |
| 0.45 | 0.144374311 | T946P | 3456 |
| 0.44 | 0.000253022 | ^L889 | 3457 |
| 0.42 | 0.000171566 | E121D | 3458 |
| 0.37 | 0.042821047 | P224K | 3459 |
| 0.37 | 0.683382544 | K767R | 3460 |
| 0.36 | 0.026543344 | E480K | 3461 |
| 0.34 | 0.000998618 | I546V | 3462 |
| 0.27 | 0.164274898 | K188E | 3463 |
| 0.22 | 0.00106697 | Y789T | 3464 |
| 0.21 | 0.000512104 | F495S | 3465 |
| 0.18 | 0.023184407 | m29E | 3466 |
| 0.18 | 0.096249035 | A238T | 3467 |
| 0.17 | 0.000141352 | d231N | 3468 |
| 0.17 | 9.49E−05 | I199F | 3469 |
| 0.17 | 0.031218317 | N737S | 3470 |
| 0.16 | 3.87E−05 | ^G661A | 3471 |
| 0.12 | 4.08E−05 | K460N | 3472 |
| 0.08 | 0.000897639 | k210R | 3473 |
| 0.08 | 3.47E−05 | G492P | 3474 |
| 0.07 | 0.000266253 | R591I | 3475 |
| 0.04 | 6.41E−05 | ^T696 | 3476 |
| 0.03 | 0.022802297 | S507G + G508R | 3477 |
| 0.02 | 0.028138538 | Y723N | 3478 |
| −0.01 | 0.000529731 | ^P696 | 3479 |
| −0.01 | 0.038340599 | g226R | 3480 |
| −0.02 | 0.052026759 | W974G | 3481 |
| −0.04 | 0.000176981 | ^M773 | 3482 |
| −0.04 | 0.07902452 | H435R | 3483 |
| −0.06 | 0.069143378 | A724S | 3484 |
| −0.06 | 0.060317972 | T704K | 3485 |
| −0.06 | 0.017155351 | Y966N | 3486 |
| −0.08 | 0.036299549 | H164R | 3487 |
| −0.15 | 0.032952207 | F556I, D646A, G695D, A751S, A820P | 3488 |
| −0.17 | 0.04149111 | D659H | 3489 |
| −0.21 | 0.064777446 | T806V | 3490 |

TABLE 7-continued

Effect of CasX Protein Variants. These mutations are relative to SEQ ID NO: 2.

| Normalized Editing Activity | Standard Deviation | Mutation Descriptor | SEQ ID NO |
|---|---|---|---|
| −0.24 | 0.001280151 | Y789D | 3491 |
| −0.31 | 0.05332531 | C479A | 3492 |
| −0.35 | 0.066448437 | L212P | 3493 |

[ ] indicate deletions, and (^) indicate insertions at the specified positions of SEQ ID NO: 2. E6 and E7 spacers were used, and the data are the average of N=6 replicates. Stdev=Standard Deviation. Editing activity was normalized to that of the reference CasX protein of SEQ ID NO: 2.

Selected CasX protein variants from the DME screen and CasX protein variants comprising combinations of mutations were assayed for their ability to disrupt via cleavage and in/del formation GFP reporter expression. CasX protein variants were assayed with two targets, with 6 replicates. FIG. 10 shows the fold improvement in activity over the reference CasX protein of SEQ ID NO: 2 of select variants carrying single mutations, assayed with the reference sgRNA scaffold of SEQ ID NO: 5.

Figure 11:
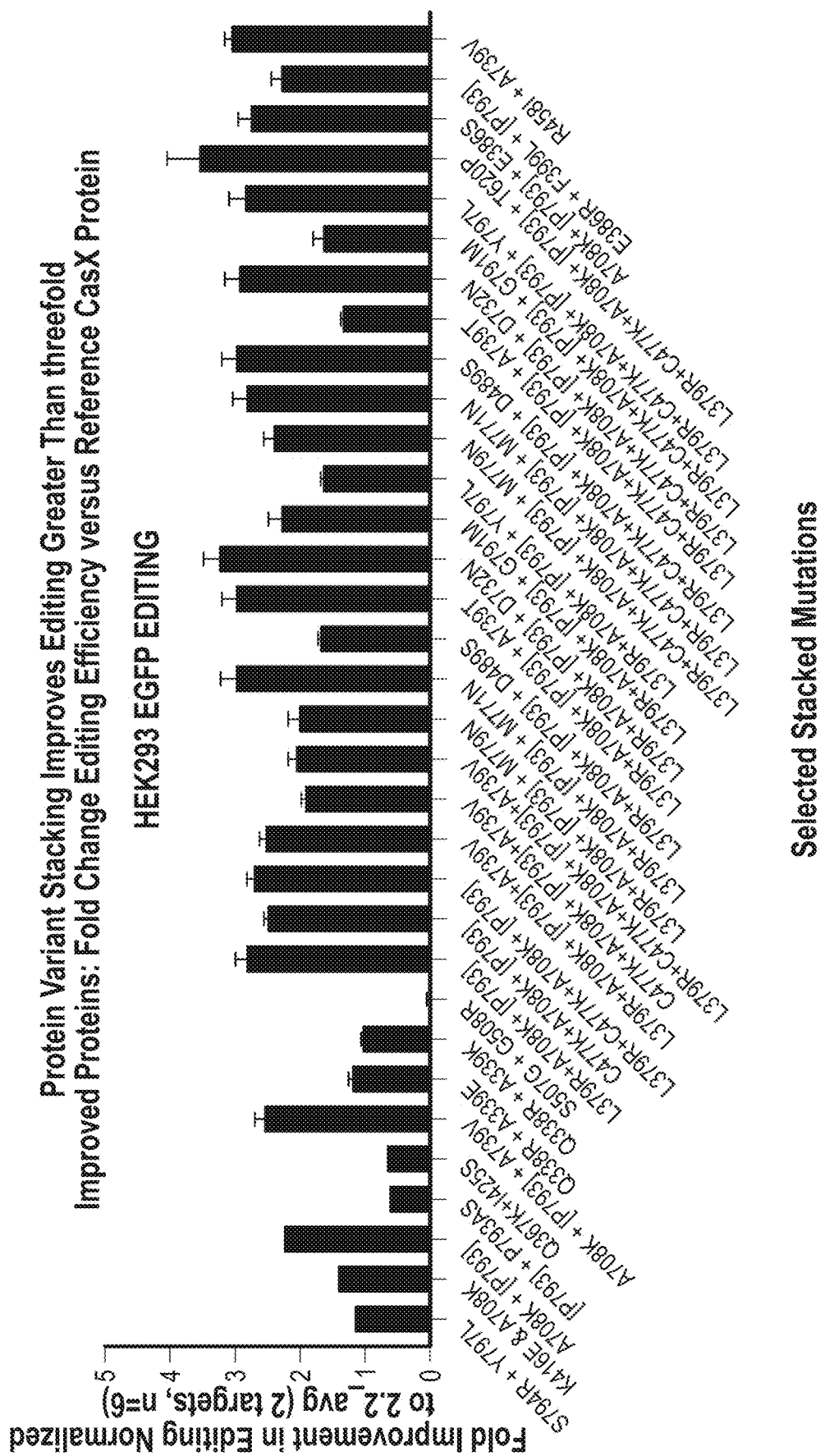
FIG. 11 is a plot showing individual beneficial mutations can be combined (sometimes referred to as "stacked") for even greater improvements in gene editing activity. CasX proteins were tested for their ability to cleave at 2 different target sites in human HEK293 cells using the E6 and E7 spacers targeting an EGFP reporter, as described in Example 5. The variants, from left to right, are: S794R+Y797L, K416E+A708K, A708K+[P793], [P793]+P793AS, Q367K+ 14255, A708K+[P793]+A793V, Q338R+A339E, Q338R+ A339K, S507G+G508R, L379R+A708K+[P793], C477K+ A708K+[P793], L379R+C477K+A708K+[P793], L379R+ A708K+[P793]+A739V, C477K+A708K+[P793]+A739V, L379R+C477K+A708K+[P793]+A739V, L379R+A708K+ [P793]+M779N, L379R+A708K+[P793]+M771N, L379R+ A708K+[P793]+D489S, L379R+A708K+[P793]+A739T, L379R+A708K+[P793]+D732N, L379R+A708K+[P793]+ G791M, L379R+A708K+[P793]+Y797L, L379R+C477K+ A708K+[P793]+M779N, L379R+C477K+A708K+[P793]+ M771N, L379R+C477K+A708K+[P793]+D489S, L379R+ C477K+A708K+[P793]+A739T, L379R+C477K+A708K+ [P793]+D732N, L379R+C477K+A708K+[P793]+G791M, L379R+C477K+A708K+[P793]+Y797L, L379R+C477K+ A708K+[P793]+T620P, A708K+[P793]+E386S, E386R+ F399L+[P793] and R4581I+A739V of the reference CasX protein of SEQ ID NO: 2. [ ] refer to deleted amino acid residues at the specified position of SEQ ID NO: 2.

FIG. 11 shows that combining single mutations, such as those shown in FIG. 10, can produce CasX protein variants, that can improve editing efficiency by greater than two fold. The most improved CasX protein variants, which combine 3 or 4 individual mutations, exhibit activity comparable to *Staphylococcus aureus* Cas9 (SaCas9) which has been used in the clinic (Maeder et al. 2019, Nature Medicine 25(2): 229-233).

Figure 12A:
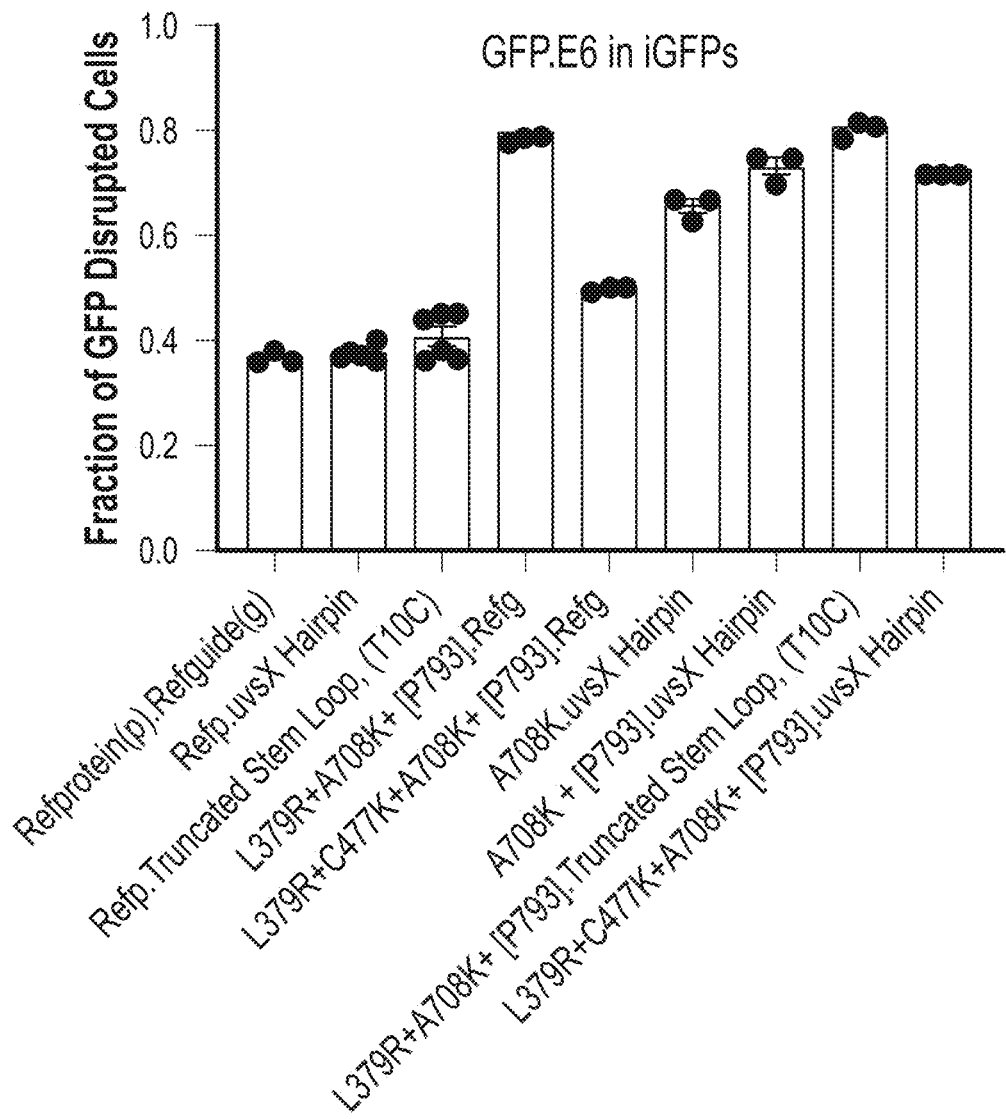
FIG. 12A and FIG. 12B are a pair of plots showing that CasX protein and sgNA variants when combined, can improve activity more than 6-fold relative to a reference sgRNA and reference CasX protein pair. sgNA:protein pairs were assayed for their ability to cleave a GFP reporter in HEK293 cells, as described in Example 5. On the Y-axis, the fraction of cells in which expression of the GFP reporter was disrupted by CasX mediated gene editing are shown.
Figure 12B:
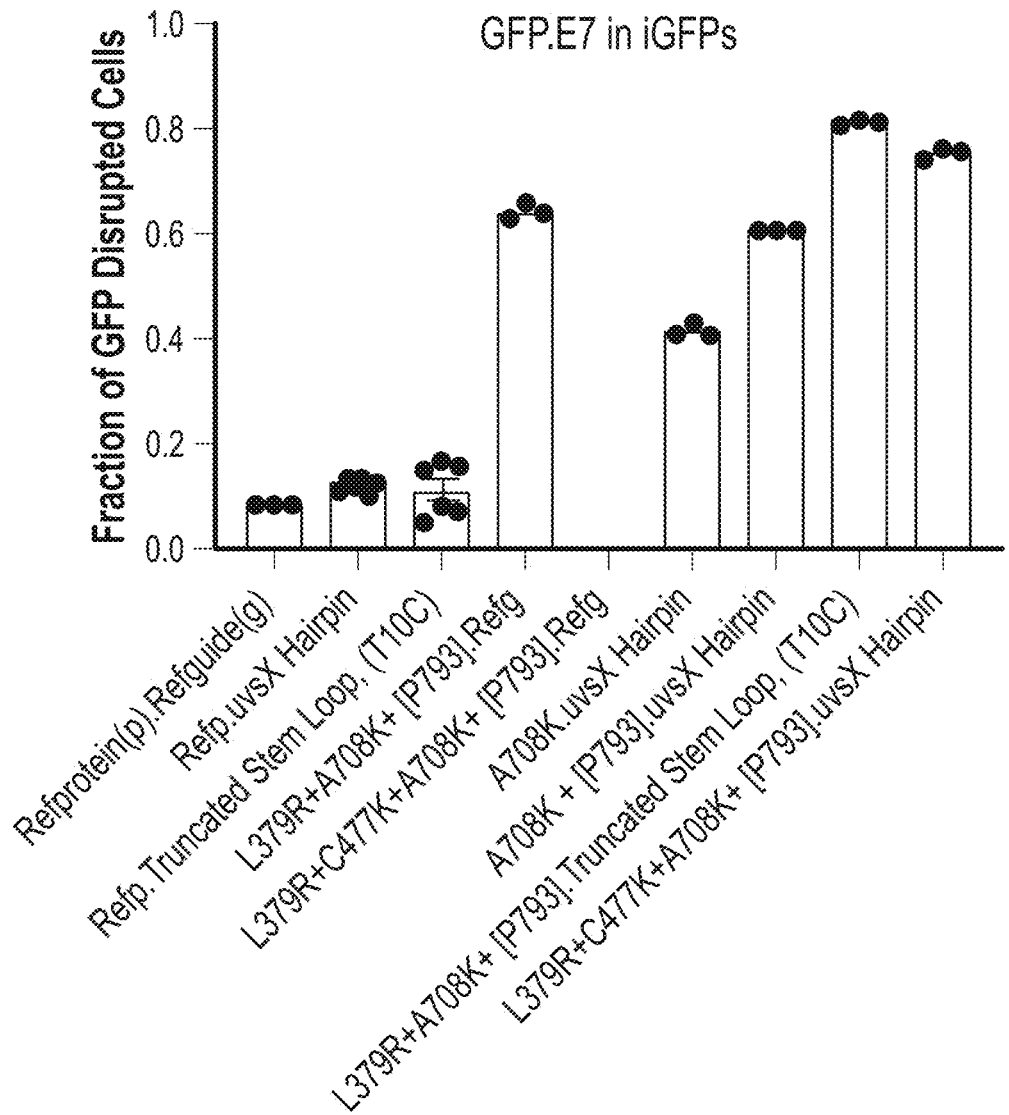

FIGS. 12A-12B shows that CasX protein variants, when combined with select sgRNA variants, can achieve even greater improvements in editing efficiency. For example, a protein variant comprising L379K and A708K substitutions, and a P793 deletion of SEQ ID NO: 2, when combined with the truncated stem loop T10C sgRNA variant more than doubles the fraction of disrupted cells.

Example 6: CasX Protein Variants can Affect PAM Specificity

The purpose of the experiment was to demonstrate the ability of CasX variant 2 (SEQ ID NO:2), and scaffold variant 2 (SEQ ID NO:5), to edit target gene sequences at ATCN, CTCN, and TTCN PAMs in a GFP gene. ATCN, CTCN, and TTCN spacers in the GFP gene were chosen based on PAM availability without prior knowledge of potential activity.

To facilitate assessment of editing outcomes, HEK293T-GFP reporter cell line was first generated by knocking into HEK293T cells a transgene cassette that constitutively expresses GFP. The modified cells were expanded by serial passage every 3-5 days and maintained in Fibroblast (FB) medium, consisting of Dulbecco's Modified Eagle Medium (DMEM; Corning Cellgro, #10-013-CV) supplemented with 10% fetal bovine serum (FBS; Seradigm, #1500-500), and 100 Units/mL penicillin and 100 mg/mL streptomycin (100×-Pen-Strep; GIBCO #15140-122), and can additionally include sodium pyruvate (100×, Thermofisher #11360070), non-essential amino acids (100× Thermofisher #11140050), HEPES buffer (100× Thermofisher #15630080), and 2-mercaptoethanol (1000× Thermofisher #21985023). The cells were incubated at 37° C. and 5% CO2. After 1-2 weeks, GFP+ cells were bulk sorted into FB medium. The reporter lines were expanded by serial passage every 3-5 days and maintained in FB medium in an incubator at 37° C. and 5% CO2. Clonal cell lines were generated by a limiting dilution method.

HEK293T-GFP reporter cells, constructed using cell line generation methods described above were used for this experiment. Cells were seeded at 20-40 k cells/well in a 96 well plate in 100 µL of FB medium and cultured in a 37° C. incubator with 5% CO2. The following day, cells were transfected at ~75% confluence using Lipofectamine™ 3000 and manufacturer recommended protocols. Plasmid DNA encoding CasX and guide construct (e.g., see table for sequences) were used to transfect cells at 100-400 ng/well, using 3 wells per construct as replicates. A non-targeting plasmid construct was used as a negative control. Cells were selected for successful transfection with puromycin at 0.3-3 µg/ml for 24-48 hours followed by recovery in FB medium. Edited cells were analyzed by flow cytometry 5 days after transduction. Briefly, cells were sequentially gated for live cells, single cells, and fraction of GFP-negative cells.

Figure 15:
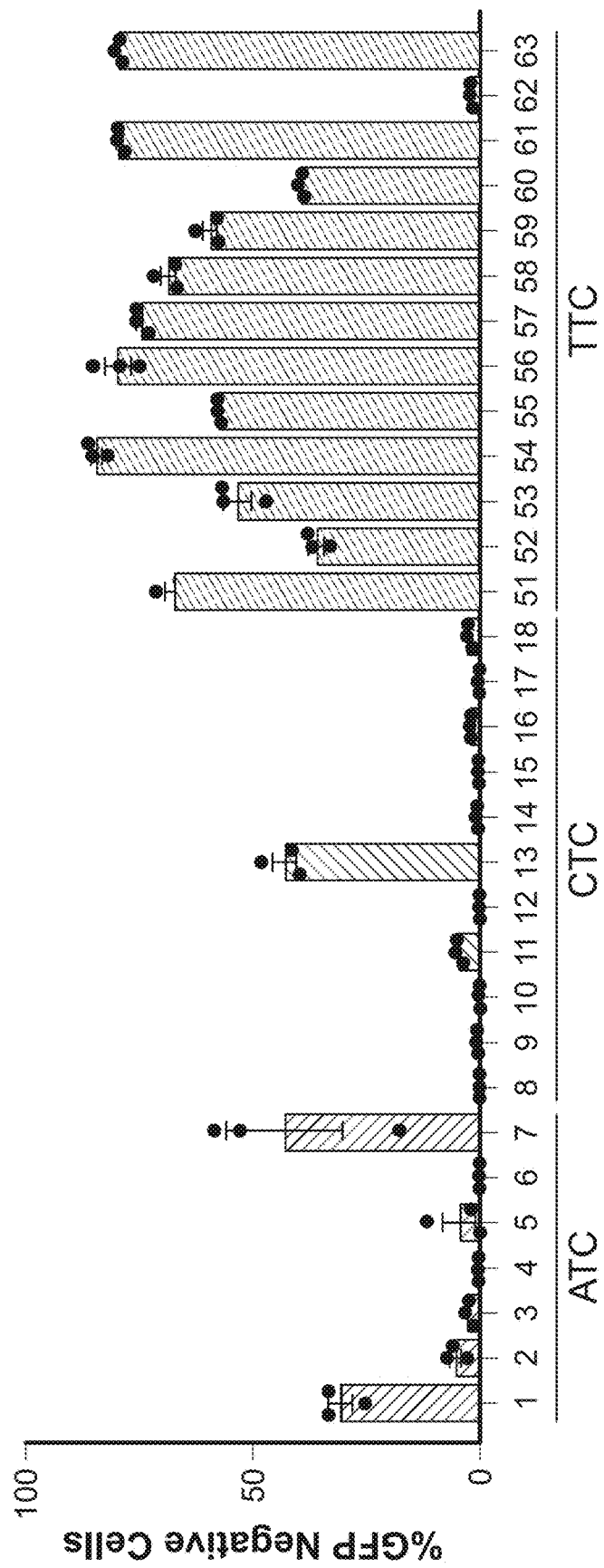
FIG. 15 is a plot showing the identification of optimal Planctomycetes CasX PAM and spacers for genes of interest, as described in Example 6. On the Y-axis, percent GFP negative cells, indicating cleavage of a GFP reporter, is shown. On the X-axis, different PAM sequences and spacers: ATC PAM, CTC PAM and TTC PAM. GTC, TTT and CTT PAMs were also tested and showed no activity.
Figure 16:
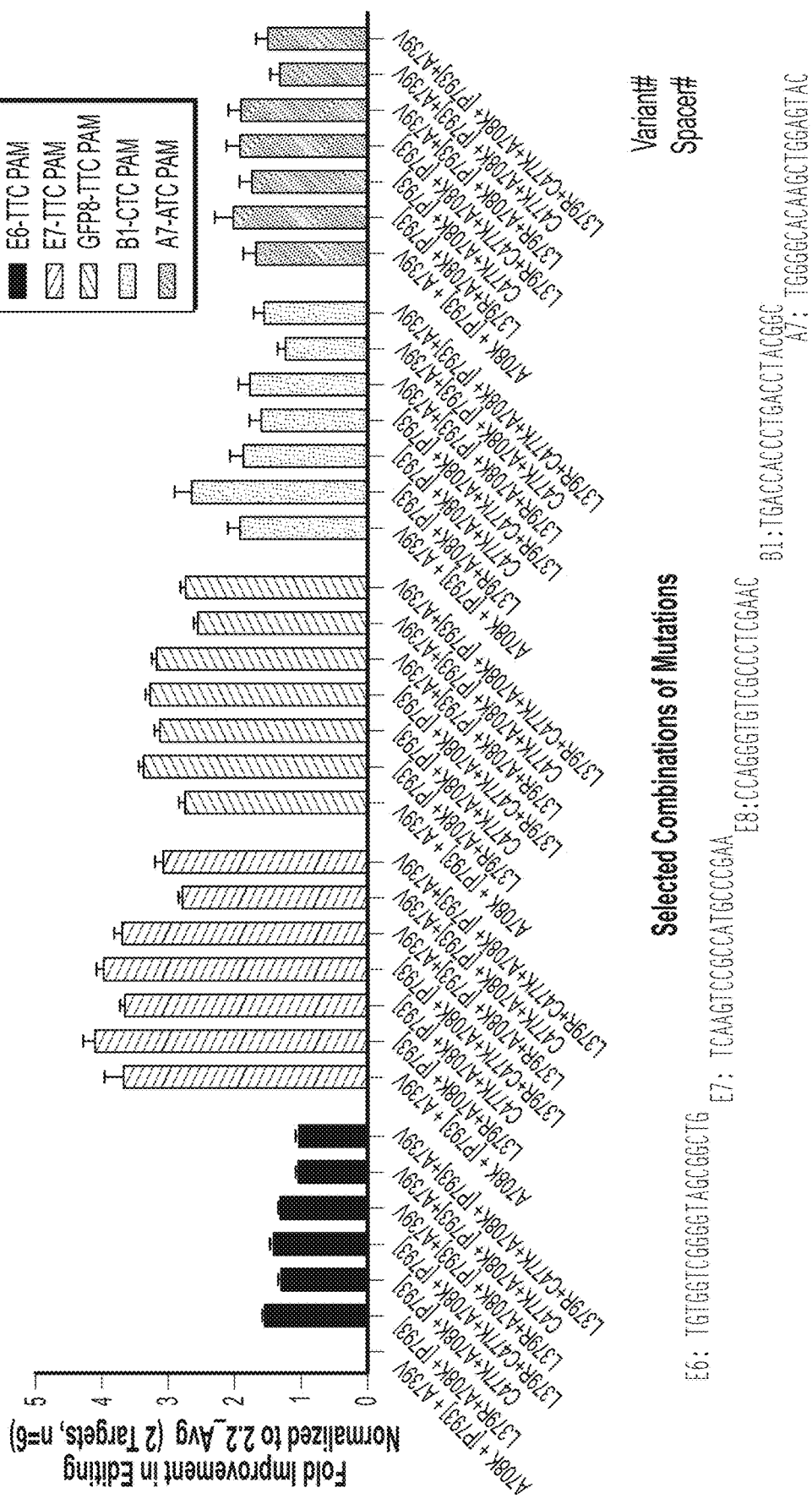
FIG. 16 is a plot showing that improved CasX variants generated by DME can edit both canonical and non-canonical PAMs more efficiently than reference CasX proteins, as described in Example 6. The Y-axis shows the average fold improvement in editing relative to a reference sgRNA: protein pair (SEQ ID NO:2, SEQ ID NO: 5) with 2 targets, N=6. Protein variants, from left to right for each set of bars were: A708K+[P793]+A739V; L379R+A708K+[P793]; C477K+A708K+[P793]; L379R+C477K+A708K+[P793]; L379R+A708K+[P793]+A739V; C477K+A708K+[P793]+A739V; and L379R+C477K+A708K+[P793]+A739V. Reference CasX and protein variants were assayed with a reference sgRNA scaffold of SEQ ID NO: 5 with DNA encoding spacer sequences of, from left to right, E6 (SEQ ID NO: 29) with a TTC PAM; E7 (SEQ ID NO: 30) with a TTC PAM; GFP8 (SEQ ID NO: 31) with a TTC PAM; B1 (SEQ ID NO: 32) with a CTC PAM and A7 (SEQ ID NO: 33) with an ATC PAM.
Figure 17A:
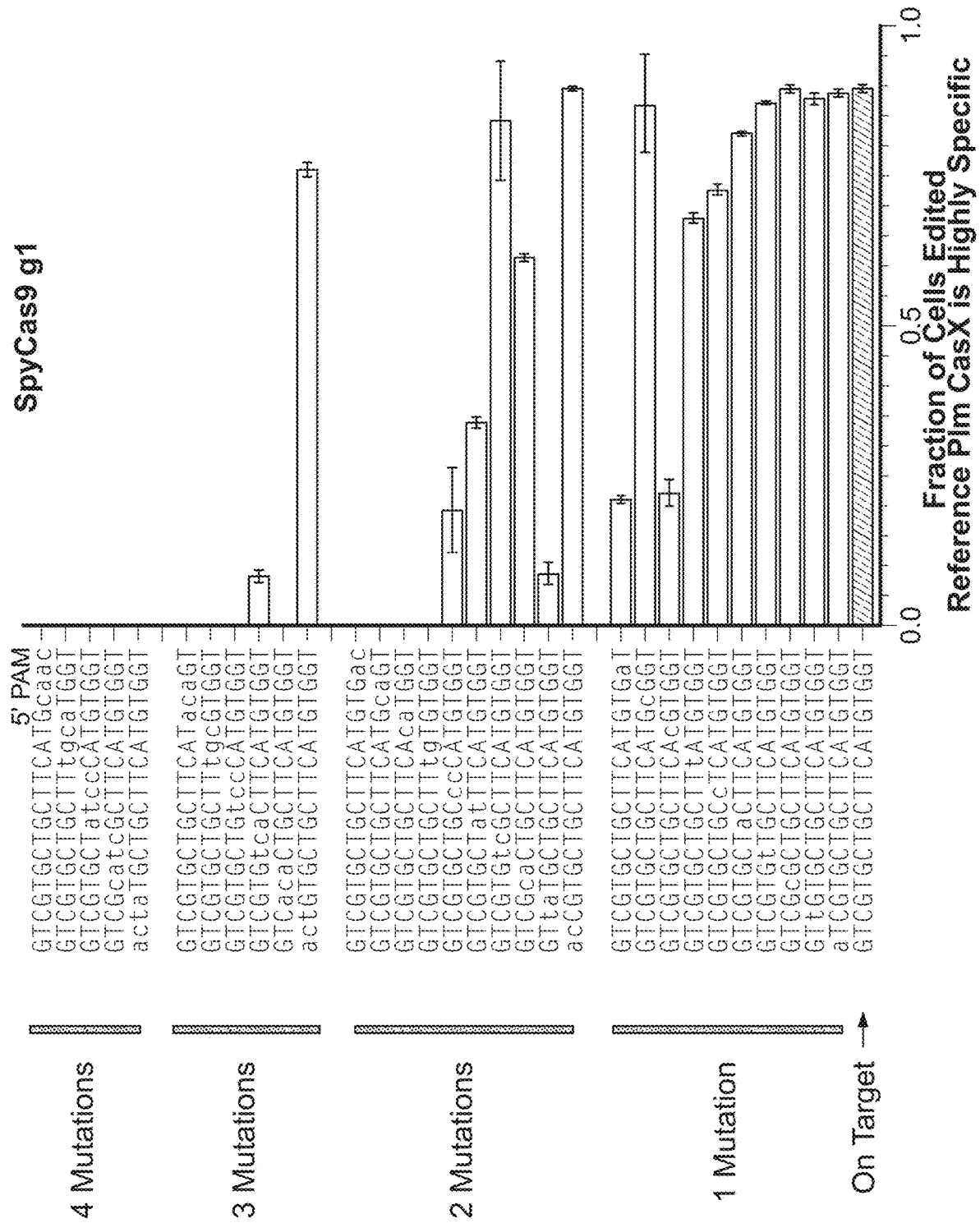
FIGS. 17A-17F are a series of plots showing that a reference CasX protein and a reference sgRNA scaffold pair is highly specific for the target sequence, as described in Example 7.
Figure 17B:
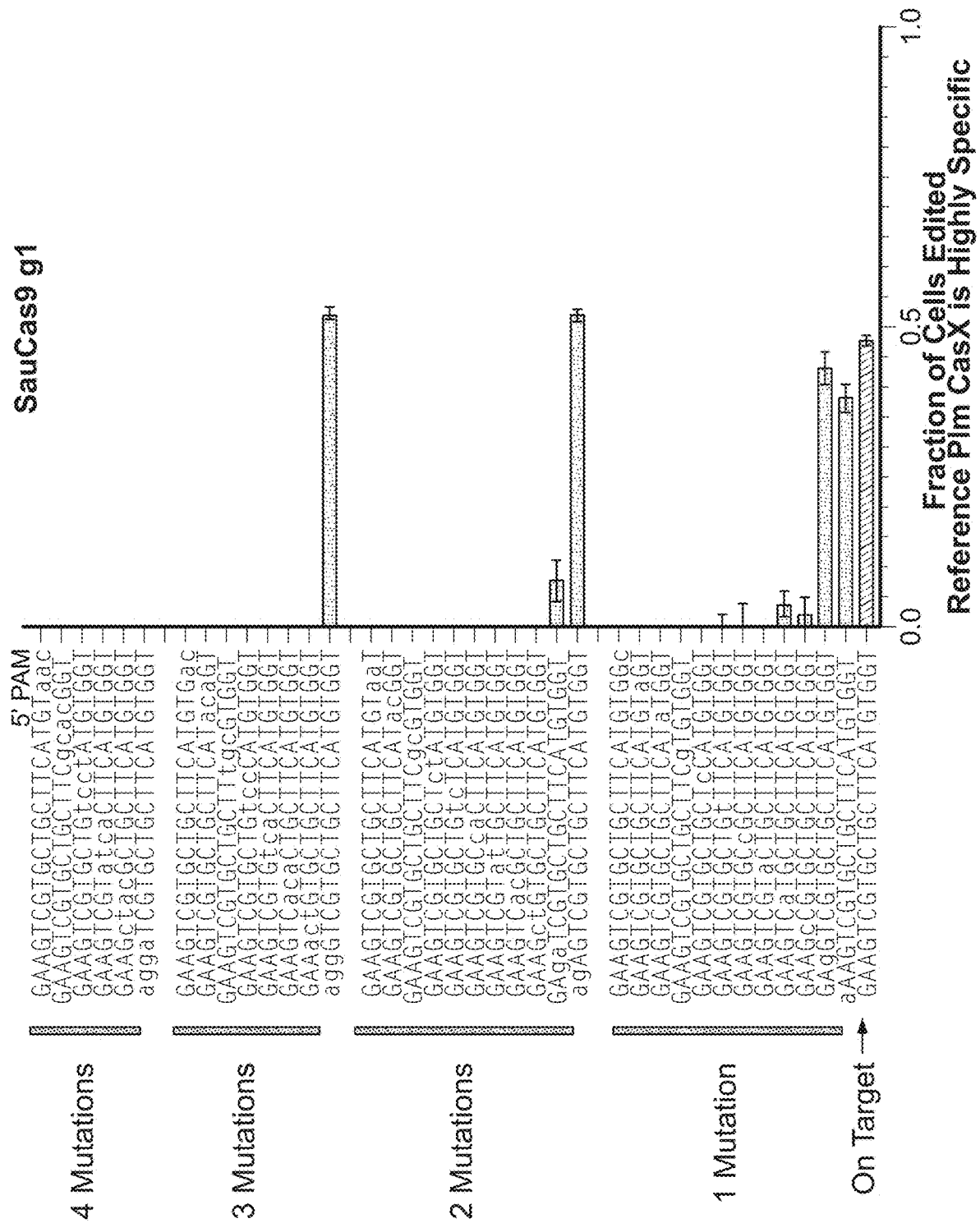
Figure 17C:
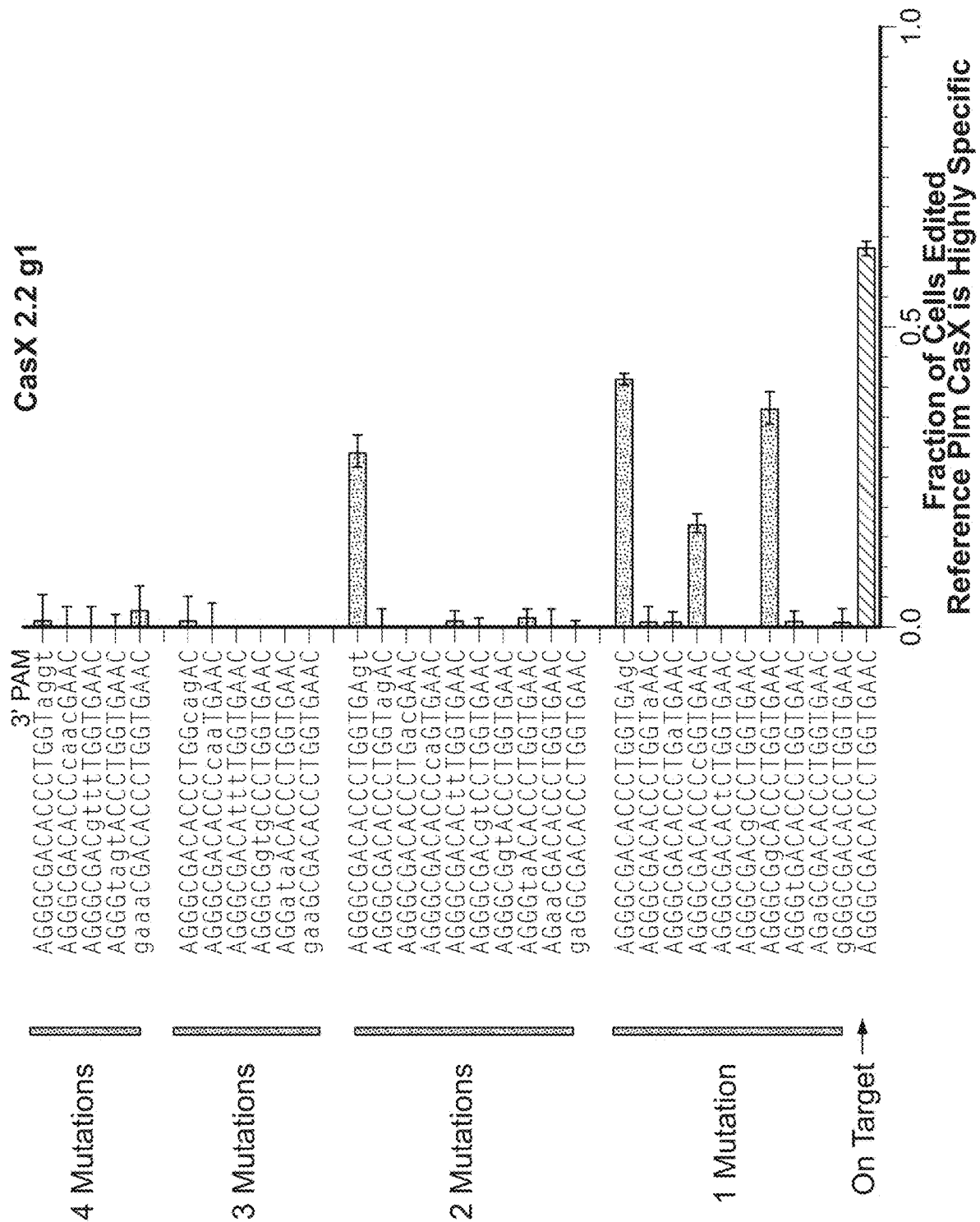
Figure 17D:
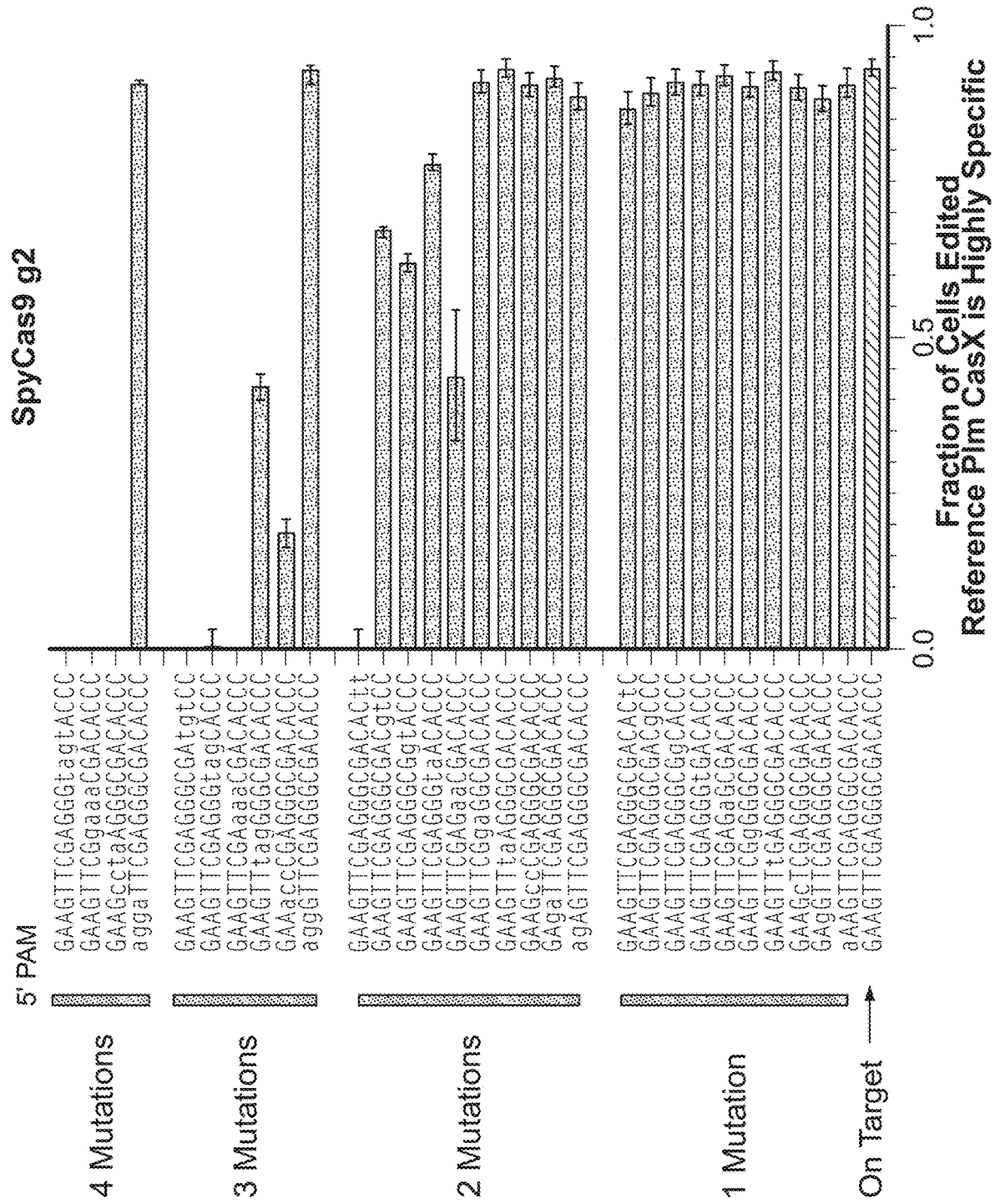
Figure 17E:
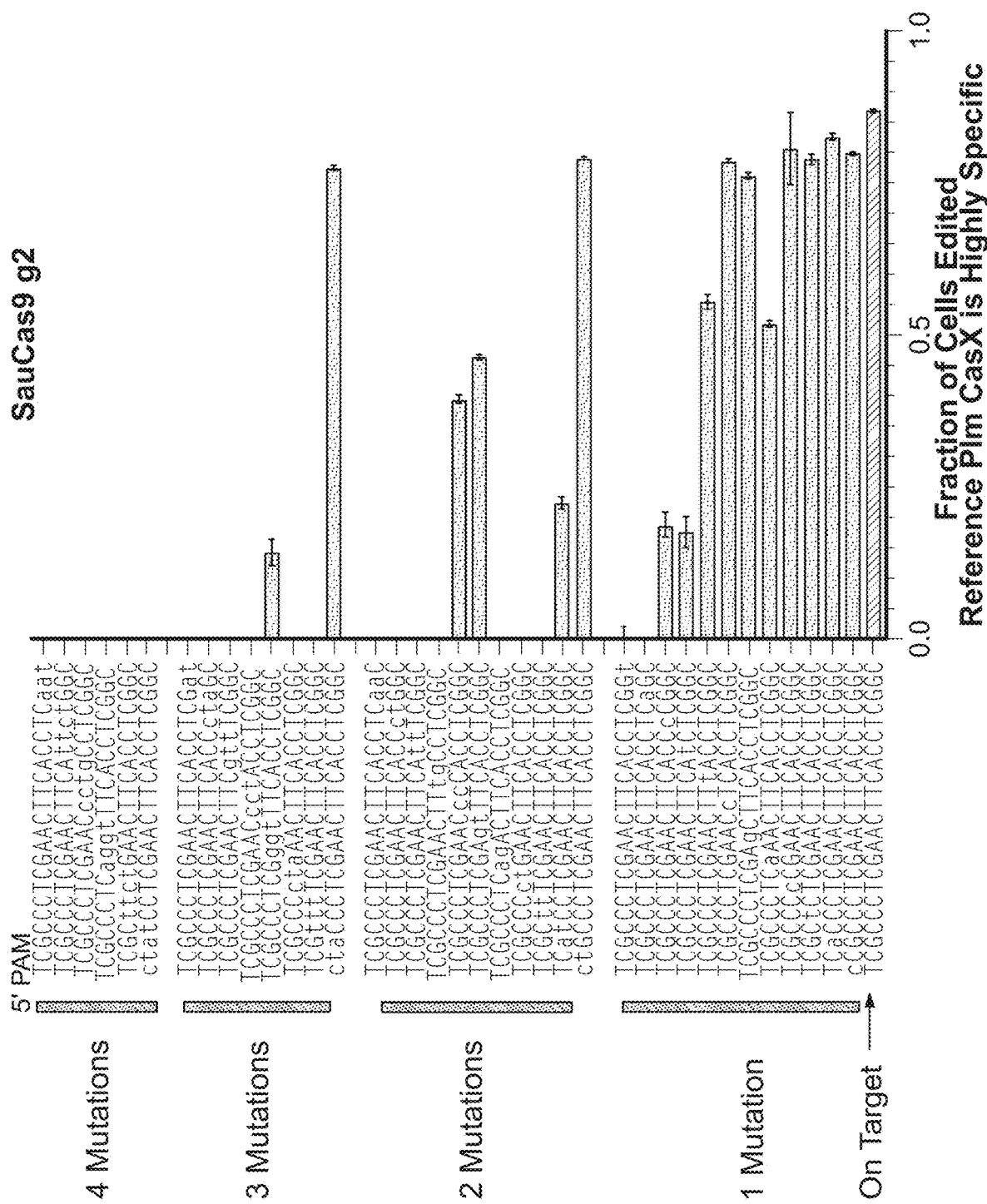
Figure 17F:
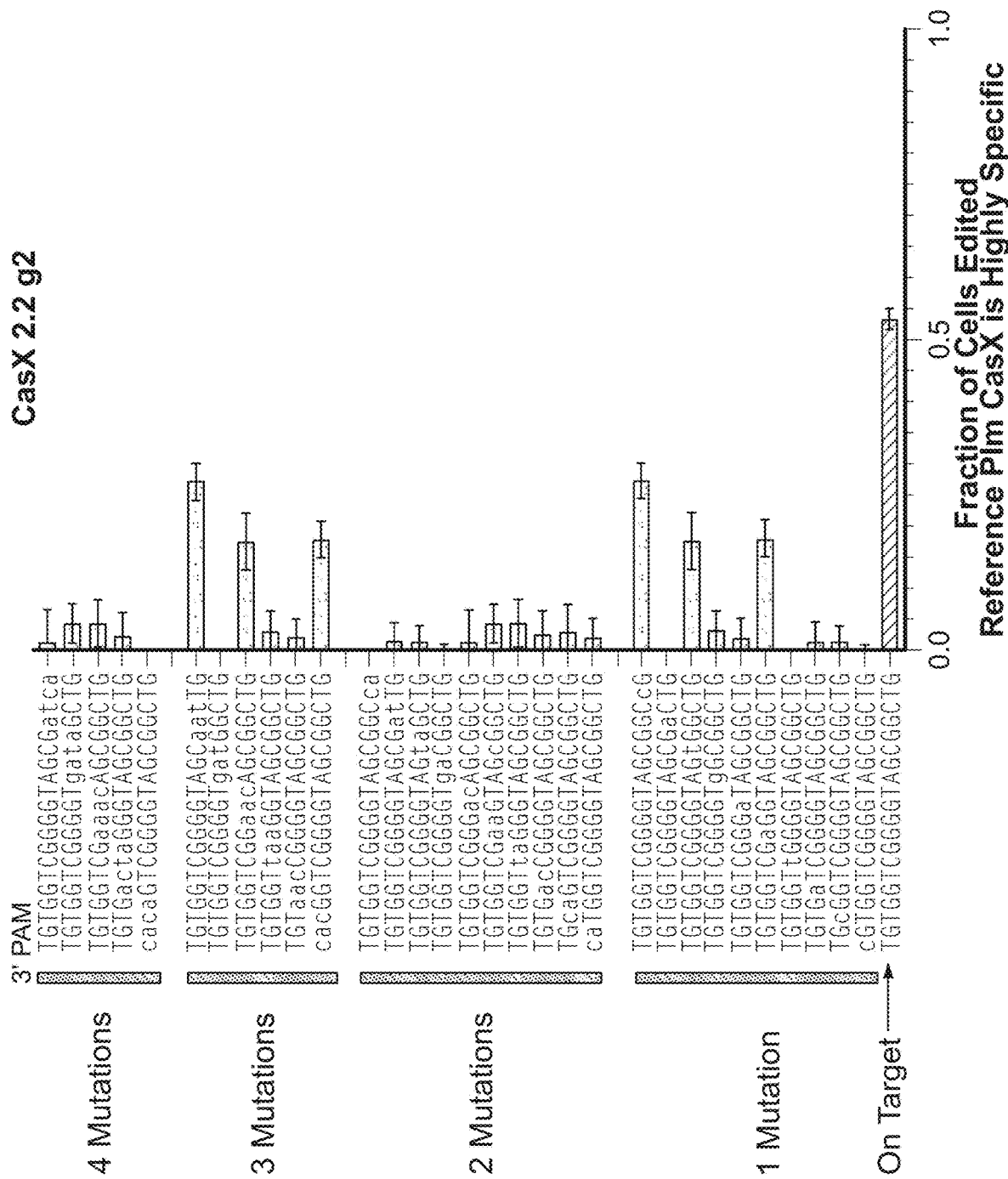
Figure 18:
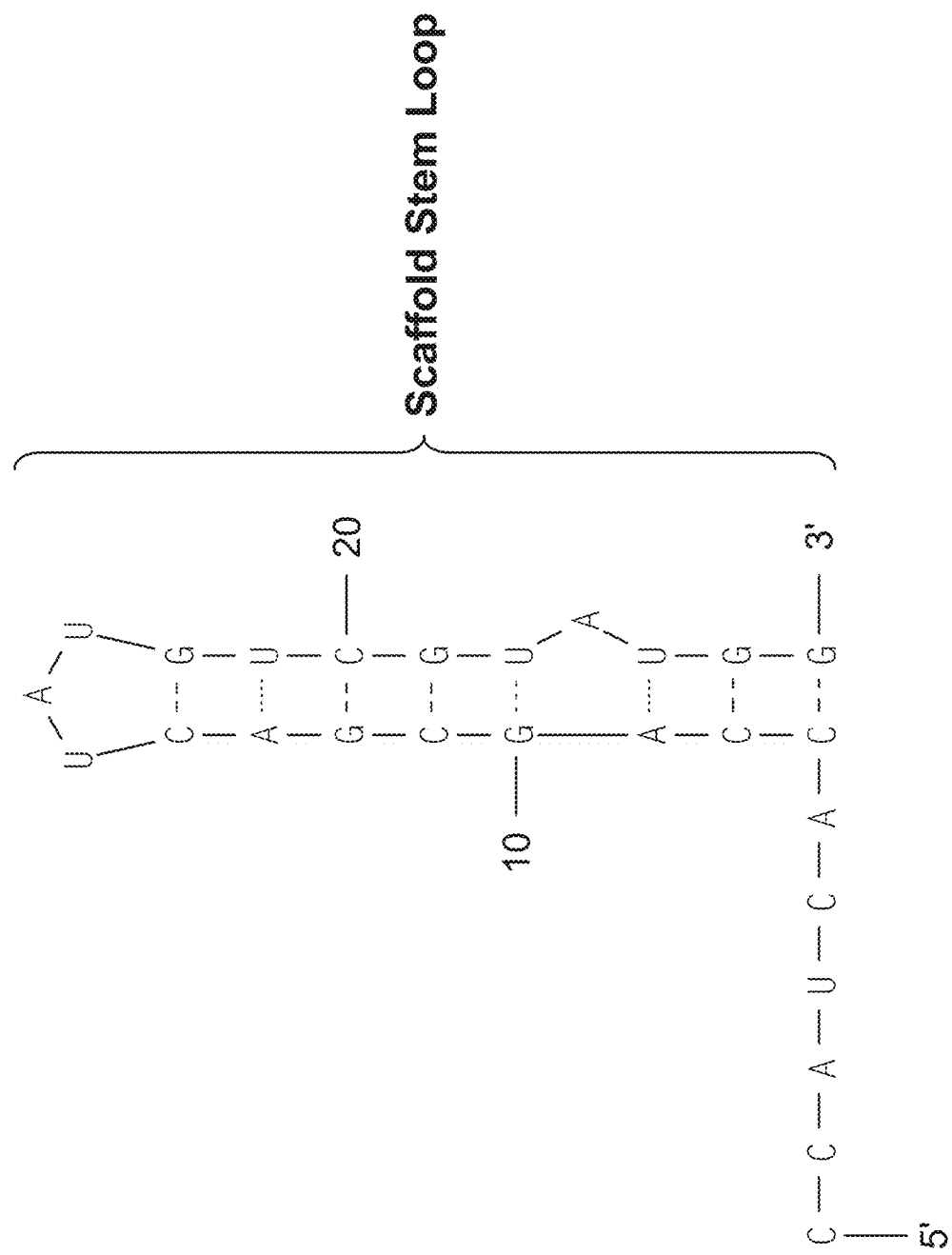
FIG. 18 illustrates a scaffold stem loop of an exemplary reference sgRNA of the disclosure (SEQ ID NO: 237).
Figure 19:
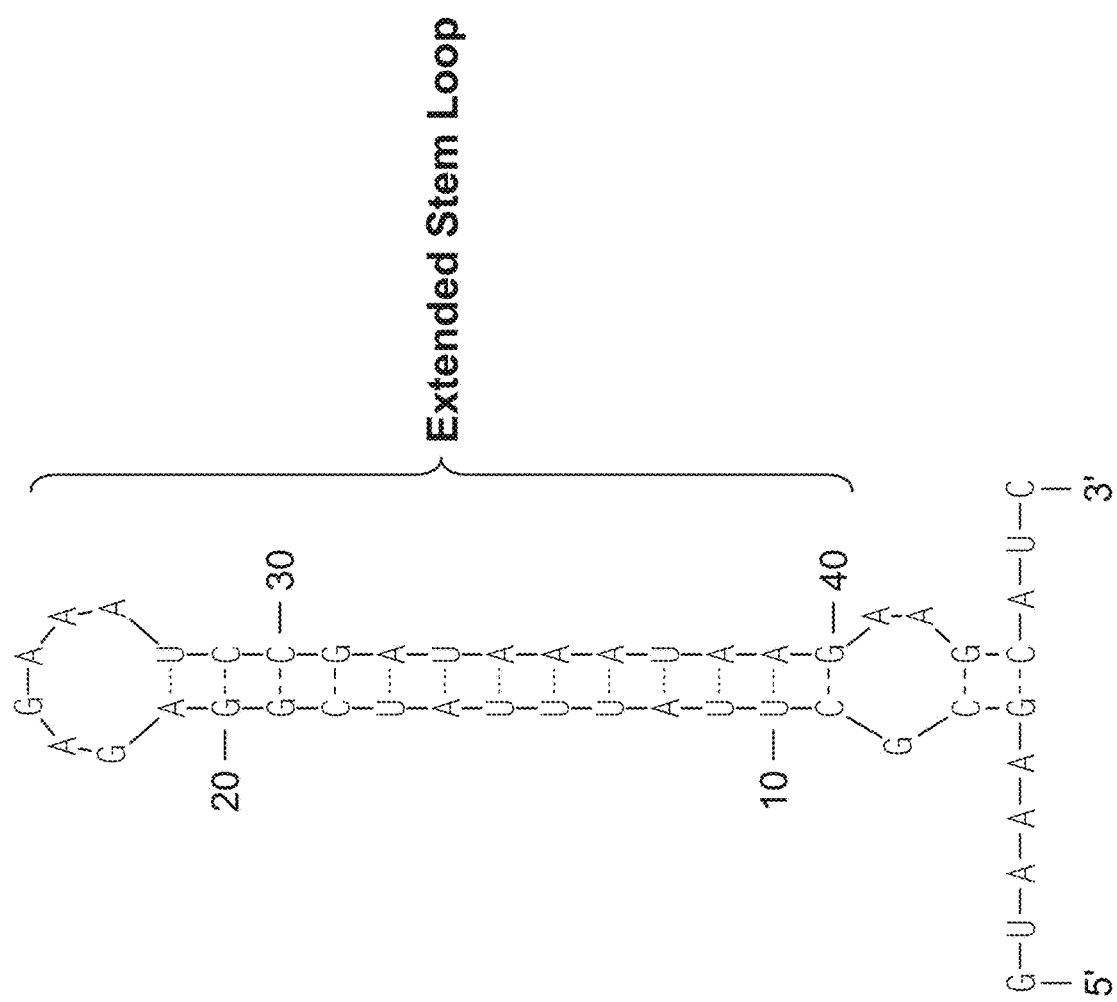
FIG. 19 illustrates an extended stem loop sequence of an exemplary reference sgRNA of the disclosure (SEQ ID NO: 238).
Figure 20A:
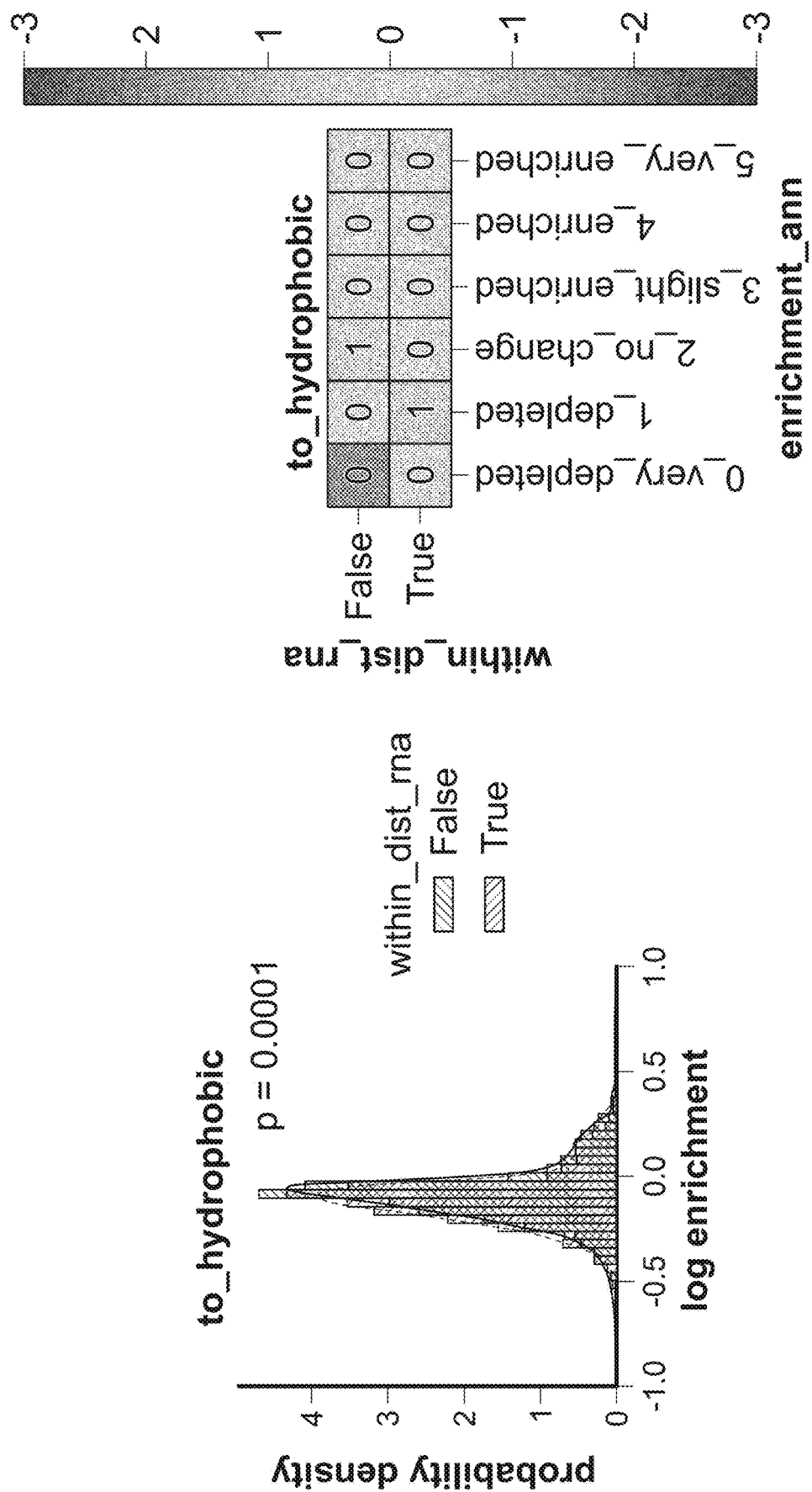
FIGS. 20A-20B are a pair of plots that demonstrate that specific subsets of changes discovered by DME of the CasX are more likely to predict improvements of activity, as described in Example 4. The plots represent data from the experiments described in FIG. 7 and FIG. 8.
Figure 20B:
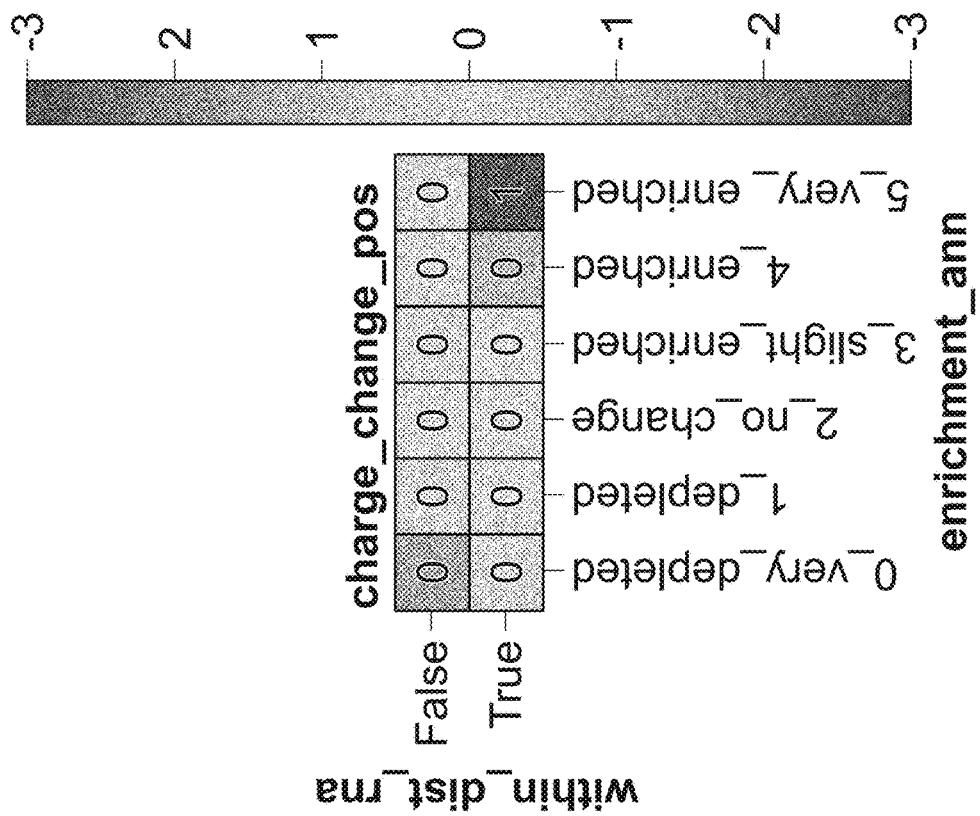
Figure 22:
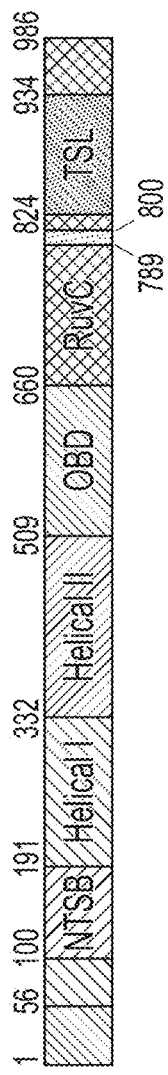
FIG. 22 illustrates the domain organization of a reference CasX protein of SEQ ID NO: 1. The domains have the following coordinates: non-target strand binding (NTSB) domain: amino acids 101-191; Helical I domain: amino acids 57-100 and 192-332; Helical II domain: 333-509; oligonucleotide binding domain (OBD): amino acids 1-56 and 510-660; RuvC DNA cleavage domain (RuvC): amino acids 551-824 and 935-986; target strand loading (TSL) domain: amino acids 825-934. Note that the Helical I, OBD and RuvC domains are non-contiguous.
Figure 23:
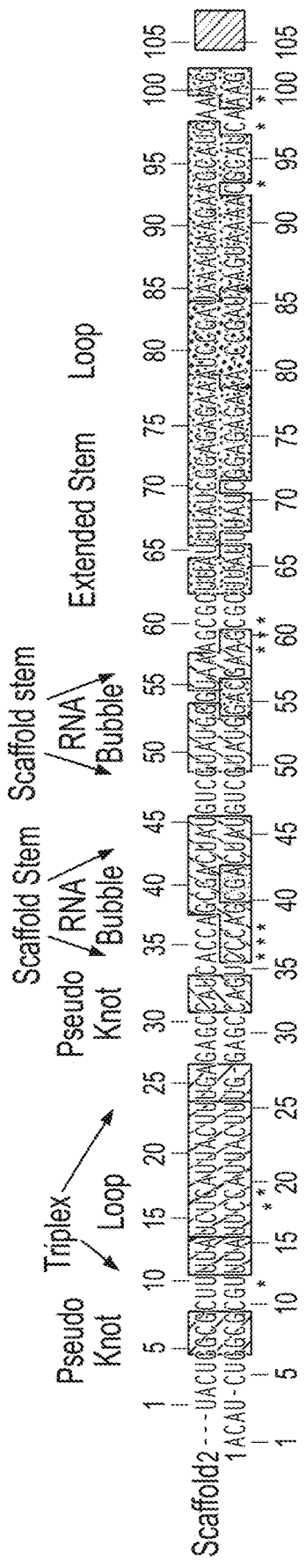
FIG. 23 illustrates an alignment of two CasX reference sgRNA scaffolds SEQ ID NO: 5 (top) and SEQ ID NO: 4 (bottom).

Results: The graph in FIG. 15 shows the results of flow cytometry analysis of Cas-mediated editing at the GFP locus in HEK293T-GFP cells 5 days post-transfection. Each data point is an average measurement of 3 replicates for an individual spacer. Reference CasX reference protein (SEQ ID NO: 2) and gRNA (SEQ ID NO: 5) RNP complexes showed a clear preference for TTC PAM (FIG. 15). This served as a baseline for CasX protein and sgRNA variants that altered specificity for the PAM sequence. FIG. 16 shows that select CasX protein variants can edit both non-canonical and canonical PAM sequences more efficiently than the reference CasX protein of SEQ ID NO: 2 when assayed with various PAM and spacer sequences in HEK293 cells. The construct with non-targeting spacer resulted in no editing (data not shown). This example demonstrates that, under the conditions of the assay, CasX with appropriate guides can edit at target sequences with ATCN, CTCN and TTCN PAMs in HEK293T-GFP reporter cells, and that improved CasX variants increase editing activity at both canonical and non-canonical PAMs.

Example 7: Reference Planctomycetes CasX RNPs are Highly Specific

Reference CasX RNP complexes were assayed for their ability to cleave target sequences with 1-4 mutations, with results shown in FIGS. 17A-17F. Reference Planctomycetes CasX RNPs were found to be highly specific and exhibited fewer off-target effects than SpyCas9 and SauCas9.

Example 8: Creation, Expression and Purification of CasX Constructs Growth and Expression Expression constructs for the CasX of Table 8 were constructed from gene fragments (Twist Biosciences) that were codon optimized for *E. coli*. The assembled construct contains a TEV-cleavable, C-terminal, TwinStrep tag and was cloned into a pBR322-derivative plasmid backbone containing an ampicillin resistance gene. The sequences of Table 8 are configured as: SV40 NLS-CasX-SV40 NLS-TEV cleavage site—TwinStrep tag. Expression constructs were transformed into chemically-competent BL21* (DE3) *E. coli* and a starter culture was grown overnight in LB broth supplemented with carbenicillin at 37° C., 180 RPM, in UltraYield Flasks (Thomson Instrument Company). The following day, this culture was used to seed expression cultures at a 1:100 v/v ratio (starter culture:expression culture). Expression cultures were inoculated into Terrific Broth (Novagen) supplemented with carbenicillin and grown in UltraYield flasks at 37° C., 180 RPM. Once the cultures reached an OD of 0.5, they were chilled to 16° C. while shaking over 2 hours and IPTG (isopropyl β-D-1-thiogalactopyranoside) was added to a final concentration of 1 mM, from a 1 M stock. The cultures were induced at 16° C., 180 RPM for 20 hours before being harvested by centrifugation at 4,000×g for 15 minutes, 4C. The cell paste was weighed and resuspended in lysis buffer (50 mM HEPES-NaOH, 250 mM NaCl, 5 mM $MgCl_2$, 1 mM TCEP, 1 mM benzamidine-HCL, 1 mM PMSF, 0.5% CHAPS, 1000 glycerol, pH 8) at a ratio of 5 mL of lysis buffer per gram of cell paste. Once resuspended, the sample was frozen at −80° C. until purification.

TABLE 8

Sequences of CasX constructs

| Construct | DNA [SEQ ID NO] | Protein [SEQ ID NO] | Amino Acid Sequence |
|---|---|---|---|
| WT CasX sequence of SEQ ID NO: 2 fused to an N terminal NLS | 3494 | 3498 | MAPKKKRKVSQEIKRINKIRRRLVKDSNTKKAGKTGPMKTLLVRVMTPD LRERLENLRKKPENIPQPISNTSRANLNKLLTDYTEMKKAILHVYWEEF QKDPVGLMSRVAQPAPKNIDQRKLIPVKDGNERLTSSGFACSQCCQPLY VYKLEQVNDKGKPHTNYFGRCNVSEHERLILLSPHKPEANDELVTYSLG KFGQRALDFYSIHVTRESNHPVKPLEQIGGNSCASGPVGKALSDACMGA VASFLTKYQDIILEHGKVIKKNEKRLANLKDIASANGLAFPKITLPPQP HTKEGIEAYNNVVAQIVIWVNLNLWQKLKIGRDEAKPLQRLKGFPSFPL VERQANEVDWWDMVCNVKKLINEKKEDGKVFWQNLAGYKRQEALLPYLS SEEDRKKGKKFARYQFGDLLLHLEKKHGEDWGKVYDEAWERIDKKVEGL SKHIKLEEERRSEDAQSKAALTDWLRAKASFVIEGLKEADKDEFCRCEL KLQKWYGDLRGKPFAIEAENSILDISGFSKQYNCAFIWQKDGVKKLNLY LIINYFKGGKLRFKKIKPEAFEANRFYTVINKKSGEIVPMEVNFNFDDP NLIILPLAFGKRQGREFIWNDLLSLETGSLKLANGRVIEKTLYNRRTRQ DEPALFVALTFERREVLDSSNIKPMNLIGIDRGENIPAVIALTDPEGCP LSRFKDSLGNPTHILRIGESYKEKQRTIQAAKEVEQRRAGGYSRKYASK AKNLADDMVRNTARDLLYYAVTQDAMLIFENLSRGFGRQGKRTFMAERQ YTRMEDWLTAKLAYEGLPSKTYLSKTLAQYTSKTCSNCGFTITSADYSR VLEKLKKTATGWMTTINGKELKVEGQITYYNRYKRQNVVKDLSVELDRL SEESVNNDISSWTKGRSGEALSLLKKRFSHRPVQEKFVCLNCGFETHAD EQAALNIARSWLFLRSQEYKKYQTNKTTGNTDKRAFVETWQSFYRKKLK EVWKPAVAPKKKRKVSENLYFQGSAWSHPQFEKGGGSGGGSGGSAWSHP QFEKGRGSGC |
| CasX 119 | 3495 | 3499 | MAPKKKRKVSQEIKRINKIRRRLVKDSNTKKAGKTGPMKTLLVRVMTPD LRERLENLRKKPENIPQPISNTSRANLNKLLTDYTEMKKAILHVYWEEF QKDPVGLMSRVAQPAPKNIDQRKLIPVKDGNERLTSSGFACSQCCQPLY VYKLEQVNDKGKPHTNYFGRCNVSEHERLILLSPHKPEANDELVTYSLG KFGQRALDFYSIHVTRESNHPVKPLEQIGGNSCASGPVGKALSDACMGA VASFLTKYQDIILEHGKVIKKNEKRLANLKDIASANGLAFPKITLPPQP HTKEGIEAYNNVVAQIVIWVNLNLWQKLKIGRDEAKPLQRLKGFPSFPL VERQANEVDWWDMVCNVKKLINEKKEDGKVFWQNLAGYKRQEALLPYLS SEEDRKKGKKFARYQFGDLLLHLEKKHGEDWGKVYDEAWERIDKKVEGL SKHIKLEEERRSEDAQSKAALTDWLRAKASFVIEGLKEADKDEFCRCEL KLQKWYGDLRGKPFAIEAENSILDISGFSKQYNCAFIWQKDGVKKLNLY LIINYFKGGKLRFKKIKPEAFEANRFYTVINKKSGEIVPMEVNFNFDDP NLIILPLAFGKRQGREFIWNDLLSLETGSLKLANGRVIEKTLYNRRTRQ DEPALFVALTFERREVLDSSNIKPMNLIGIDRGENIPAVIALTDPEGCP LSRFKDSLGNPTHILRIGESYKEKQRTIQAAKEVEQRRAGGYSRKYASK AKNLADDMVRNTARDLLYYAVTQDAMLIFENLSRGFGRQGKRTFMAERQ YTRMEDWLTAKLAYEGLSKTYLSKTLAQYTSKTCSNCGFTITSADYDRV LEKLKKTATGWMTTINGKELKVEGQITYYNRYKRQNVVKDLSVELDRLS EESVNNDISSWTKGRSGEALSLLKKRFSHRPVQEKFVCLNCGFETHADE QAALNIARSWLFLRSQEYKKYQTNKTTGNTDKRAFVETWQSFYRKKLKE VWKPAVPPAPKKKRKVSENLYFQGSAWSHPQFEKGGGSGGGSGGSAWSH PQFEKGRGSGC |
| CasX 438 | 3496 | 3500 | MAPKKKRKVSQEIKRINKIRRRLVKDSNTKKAGKTGPMKTLLVRVMTPD LRERLENLRKKPENIPQPISNTSRANLNKLLTDYTEMKKAILHVYWEEF QKDPVGLMSRVAQPAPKNIDQRKLIPVKDGNERLTSSGFACSQCCQPLY VYKLEQVNDKGKPHTNYFGRCNVSEHERLILLSPHKPEANDELVTYSLG KFGQRALDFYSIHVTRESNHPVKPLEQIGGNSCASGPVGKALSDACMGA VASFLTKYQDIILEHGKVIKKNEKRLANLKDIASANGLAFPKITLPPQP HTKEGIEAYNNVVAQIVIWVNLNLWQKLKIGRDEAKPLQRLKGFPSFPL VERQANEVDWWDMVCNVKKLINEKKEDGKVFWQNLAGYKRQEALLPYLS SEEDRKKGKKFARYQFGDLLLHLEKKHGEDWGKVYDEAWERIDKKVEGL SKHIKLEEERRSEDAQSKAALTDWLRAKASFVIEGLKEADKDEFCRCEL |

TABLE 8-continued

Sequences of CasX constructs

| Construct | DNA [SEQ ID NO] | Protein [SEQ ID NO] | Amino Acid Sequence |
|---|---|---|---|
| | | | KLQKWYGDLRGKPFAIEAENSILDISGFSKQYNCAFIWQKDGVKKLNLY<br>LIINYFKGGKLRFKKIKPEAFEANRFYTVINKKSGEIVPMEVNFNFDDP<br>NLIILPLAFGKRQGREFIWNDLLSLETGSLKLANGRVIEKTLYNRRTRQ<br>DEPALFVALTFERREVLDSSNIKPMNLIGIDRGENIPAVIALTDPEGCP<br>LSRFKDSLGNPTHILRIGESYKEKQRTIQAAKEVEQRRAGGYSRKYASK<br>AKNLADDMVRNTARDLLYYAVTQDAMLIFENLSRGFGRQGKRTFMAERQ<br>YTRMEDWLTAKLAYEGLSKTYLSKTLAQYTSKTCSNCGFTITSADYDRV<br>LEKLKKTATGWMTTINGKELKVEGQITYYNRYKRQNVVKDLSVELDRLS<br>EESVNNDISSWTKGRSGEALSLLKKRFSHRPVQEKFVCLNCGFETHADE<br>QAALNIARSWLFLRSQEYKKYQTNKTTGNTDKRAFVETWQSFYRKKLKE<br>VWKPAVPPAPKKKRKVSENLYFQGSAWSHPQFEKGGGSGGGSGGSAWSH<br>PQFEKGRGSGC |
| CasX 457 | 3497 | 3501 | MAPKKKRKVSQEIKRINKIRRRLVKDSNTKKAGKTGPMKTLLVRVMTPD<br>LRERLENLRKKPENIPQPISNTSRANLNKLLTDYTEMKKAILHVYWEEF<br>QKDPVGLMSRVAQPAPKNIDQRKLIPVKDGNERLTSSGFACSQCCQPLY<br>VYKLEQVNDKGKPHTNYFGRCNVSEHERLILLSPHKPEANDELVTYSLG<br>KFGQRALDFYSIHVTRESNHPVKPLEQIGGNSCASGPVGKALSDACMGA<br>VASFLTKYQDIILEHGKVIKKNEKRLANLKDIASANGLAFPKITLPPQP<br>HTKEGIEAYNNVVAQIVIWVNLNLWQKLKIGRDEAKPLQRLKGFPSFPL<br>VERQANEVDWWDMVCNVKKLINEKKEDGKVFWQNLAGYKRQEALLPYLS<br>SEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCEL<br>KLQKWYGDLRGKPFAIEAENSILDISGFSKQYNCAFIWQKDGVKKLNLY<br>LIINYFKGGKLRFKKIKPEAFEANRFYTVINKKSGEIVPMEVNFNFDDP<br>NLIILPLAFGKRQGREFIWNDLLSLETGSLKLANGRVIEKTLYNRRTRQ<br>DEPALFVALTFERREVLDSSNIKPMNLIGIDRGENIPAVIALTDPEGCP<br>LSRFKDSLGNPTHILRIGESYKEKQRTIQAAKEVEQRRAGGYSRKYASK<br>AKNLADDMVRNTARDLLYYAVTQDAMLIFENLSRGFGRQGKRTFMAERQ<br>YTRMEDWLTAKLAYEGLSKTYLSKTLAQYTSKTCSNCGFTITSADYDRV<br>LEKLKKTATGWMTTINGKELKVEGQITYYNRYKRQNVVKDLSVELDRLS<br>EESVNNDISSWTKGRSGEALSLLKKRFSHRPVQEKFVCLNCGFETHADE<br>QAALNIARSWLFLRSQEYKKYQTNKTTGNTDKRAFVETWQSFYRKKLKE<br>VWKPAVPPAPKKKRKVSENLYFQGSAWSHPQFEKGGGSGGGSGGSAWSH<br>PQFEKGRGSGC |

Purification

Frozen samples were thawed overnight at 4° C. with gentle rocking. The viscosity of the resulting lysate was reduced by sonication and lysis was completed by homogenization in three passes at 17 k PSI using an Emulsiflex C3 homogeniser (Avestin). Lysate was clarified by centrifugation at 50,000×g, 4° C., for 30 minutes and the supernatant was collected. The clarified supernatant was applied to a Heparin 6 Fast Flow column (GE Life Sciences) using an AKTA Pure 25M FPLC system (GE Life Sciences). The column was washed with 5 CV of Heparin Buffer A (50 mM HEPES-NaOH, 250 mM NaCl, 5 mM $MgCl_2$, 1 mM TCEP, 10% glycerol, pH 8), then with 3 CV of Heparin Buffer B (Buffer A with the NaCl concentration adjusted to 500 mM). Protein was eluted with 1.75 CV of Heparin Buffer C (Buffer A with the NaCl concentration adjusted to 1 M). The heparin eluate was applied to a StrepTactin HP column (GE Life Sciences) by AKTA FPLC. The column was washed with 10 CV of Strep Buffer (50 mM HEPES-NaOH, 500 mM NaCl, 5 mM $MgCl_2$, 1 mM TCEP, 10% glycerol, pH 8). Protein was eluted from the column using 2 CV of Strep Buffer with 2.5 mM Desthiobiotin added and collected in 0.8 CV fractions. CasX-containing fractions were pooled, concentrated at 4° C. using a 50 kDa cut-off spin concentrator (Millipore Sigma), and purified by size exclusion chromatography on a Superdex 200 pg column (GE Life Sciences) operated by AKTA FPLC. The column was equilibrated with SEC Buffer (25 mM sodium phosphate, 300 mM NaCl, 1 mM TCEP, 10% glycerol, pH 7.25). CasX-containing fractions that eluted at the appropriate molecular weight were pooled, concentrated at 4° C. using a 50 kDa cut-off spin concentrator, aliquoted, and snap-frozen in liquid nitrogen before being stored at −80° C.

Results

Following the growth and purification sections above, the following results were obtained.

Figure 24:
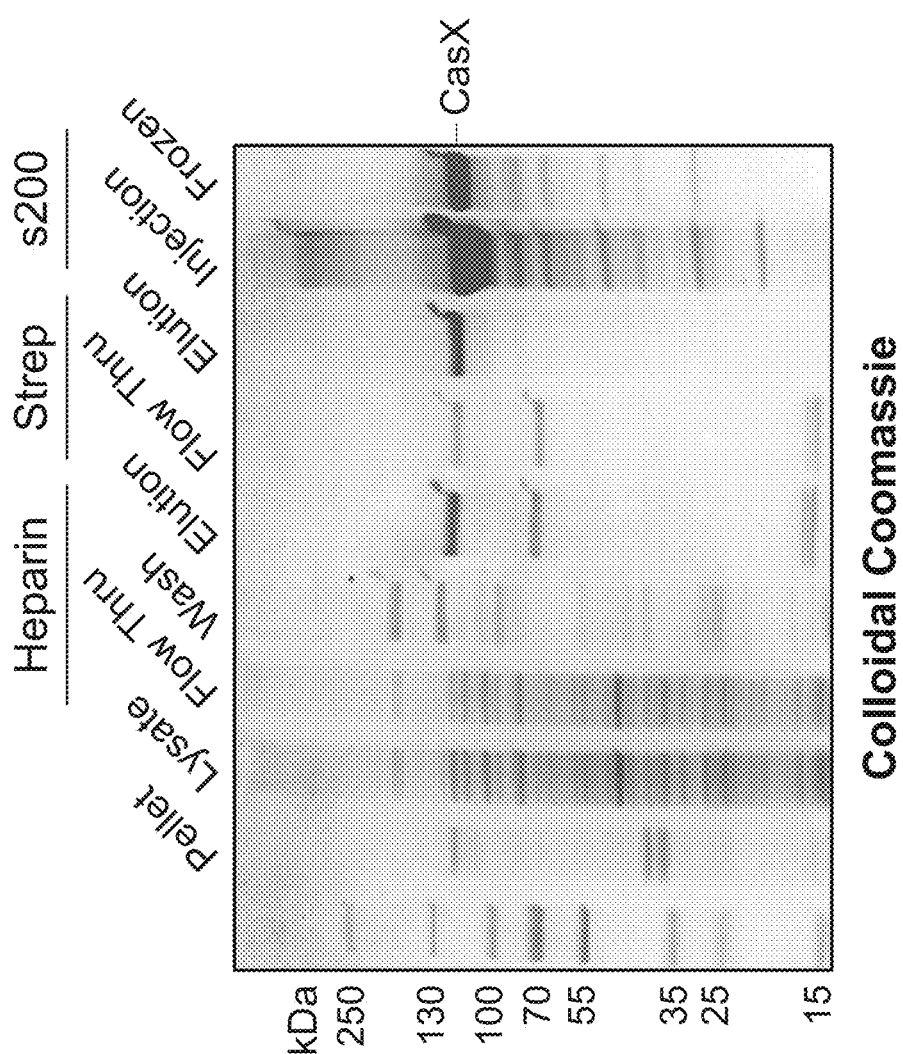
FIG. 24 shows an SDS-PAGE gel of StX2 (CasX reference of SEQ ID NO: 2) purification fractions visualized by colloidal Coomassie staining, as described in Example 8. The lanes, from left to right, are: Pellet: insoluble portion following cell lysis, Lysate: soluble portion following cell lysis, Flow Thru: protein that did not bind the heparin column, Wash: protein that eluted from the column in wash buffer, Elution: protein eluted from the heparin column with elution buffer, Flow Thru: Protein that did not bind the StrepTactin column, Elution: protein eluted from the StrepTactin column with elution buffer, Injection: concentrated protein injected onto the s200 gel filtration column, Frozen: pooled fractions from the s200 elution that have been concentrated and frozen.
Figure 25:
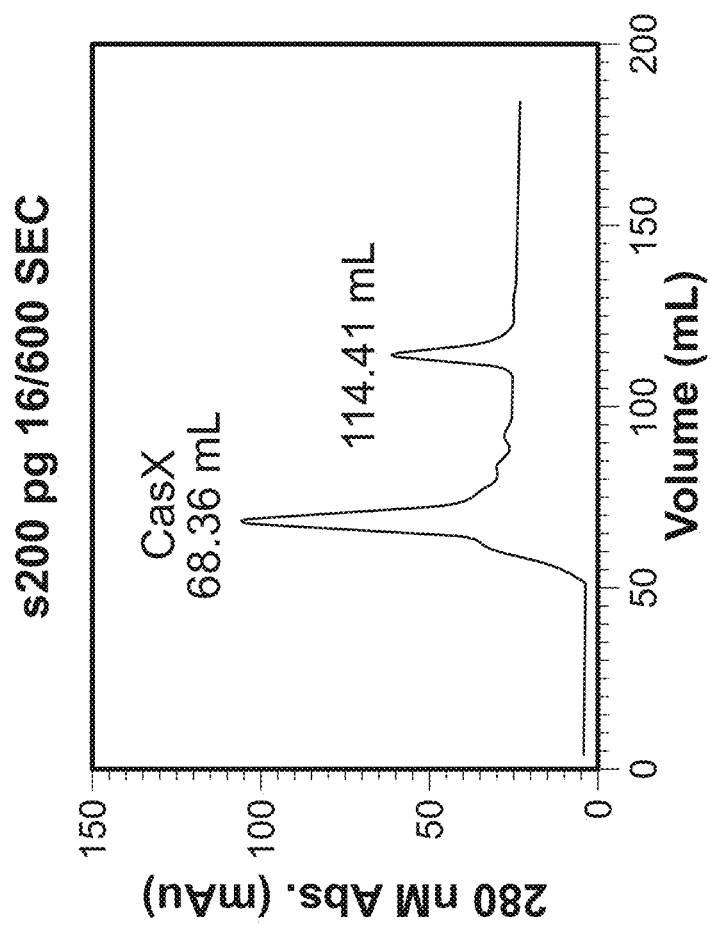
FIG. 25 shows the chromatogram from a size exclusion chromatography assay of the StX2, as described in Example 8.
Figure 26:
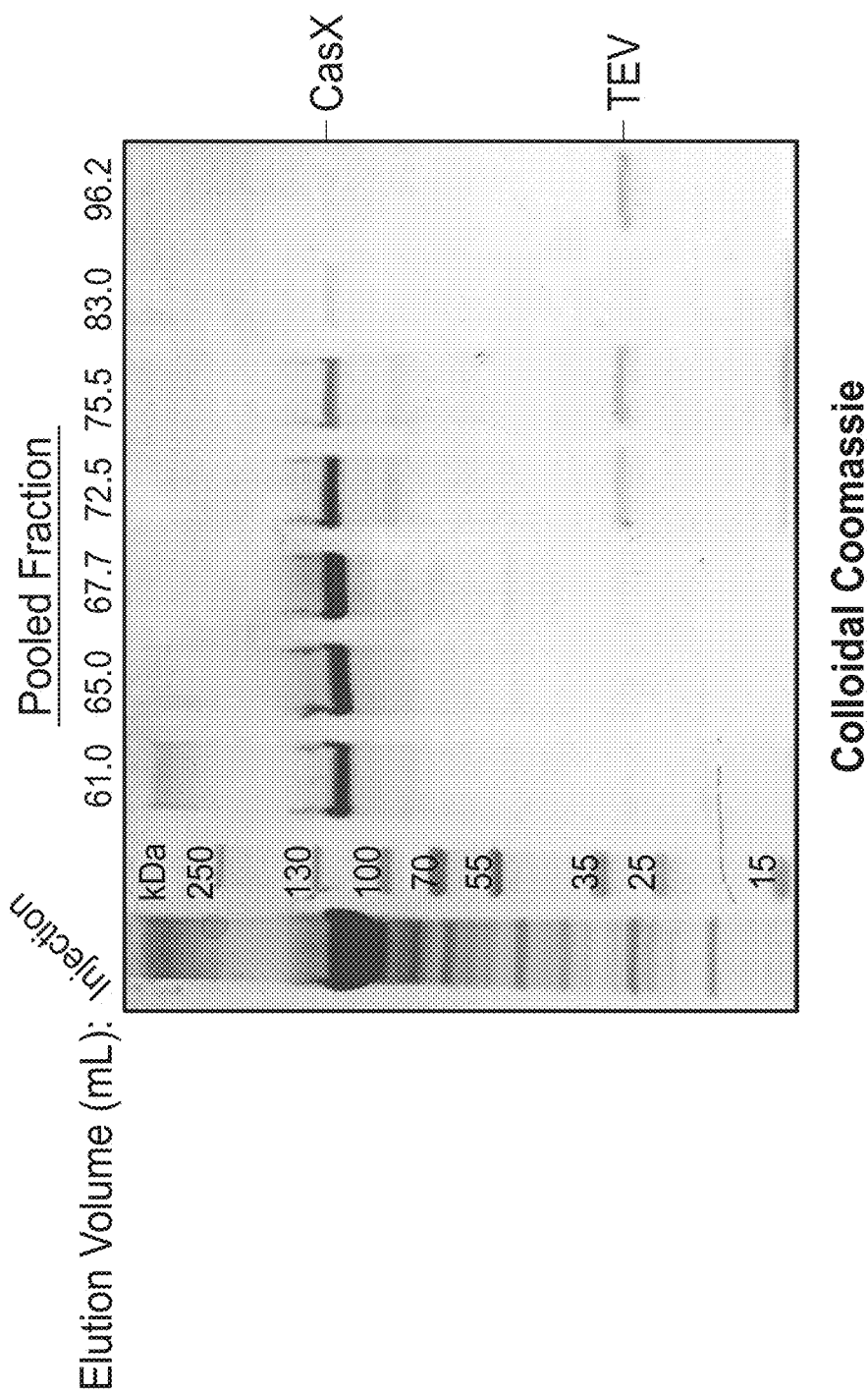
FIG. 26 shows an SDS-PAGE gel of StX2 purification fractions visualized by colloidal Coomassie staining, as described in Example 8. From right to left: Injection sample, molecular weight markers, lanes 3-9: samples from the indicated elution volumes.

WT CasX derived from Planctomycetes (SEQ ID NO:2): Samples from throughout the purification procedure were resolved by SDS-PAGE and visualized by colloidal Coomassie staining, as shown in FIGS. 24 and 26. Results from the gel filtration are shown in FIG. 25.

The average yield was 0.75 mg of purified CasX protein per liter of culture at 75% purity, as evaluated by colloidal Coomassie staining.

Figure 27:
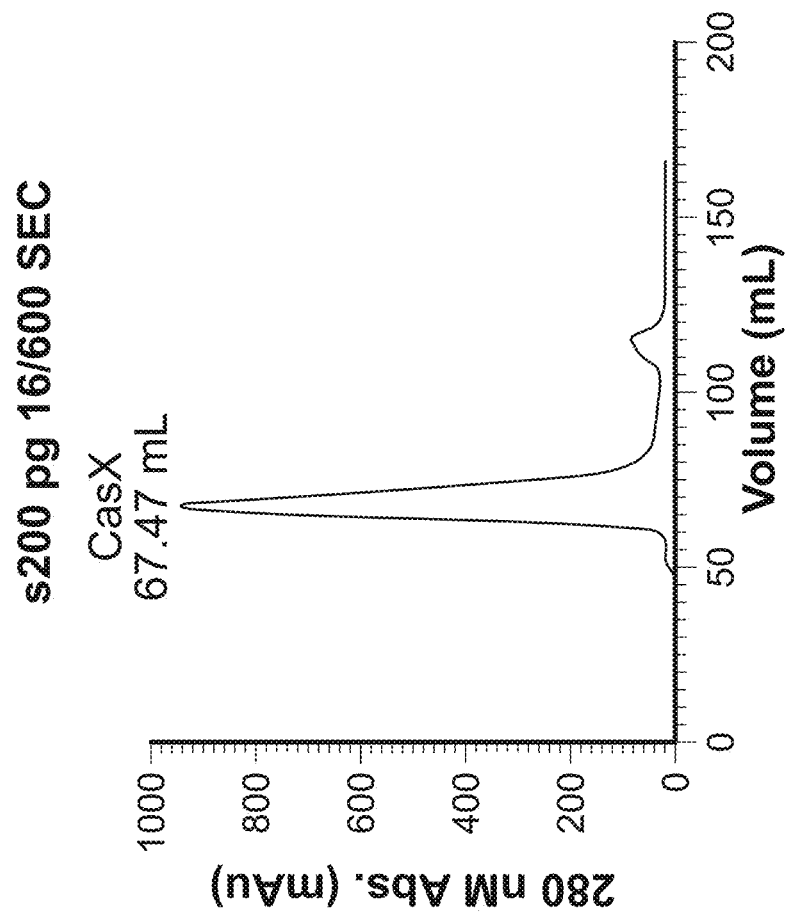
FIG. 27 shows the chromatogram from a size exclusion chromatography assay of the CasX 119, using of Superdex 200 16/600 pg gel filtration, as described in Example 8. The 67.47 mL peak corresponds to the apparent molecular weight of CasX variant 119 and contained the majority of CasX variant 119 protein.
Figure 28:
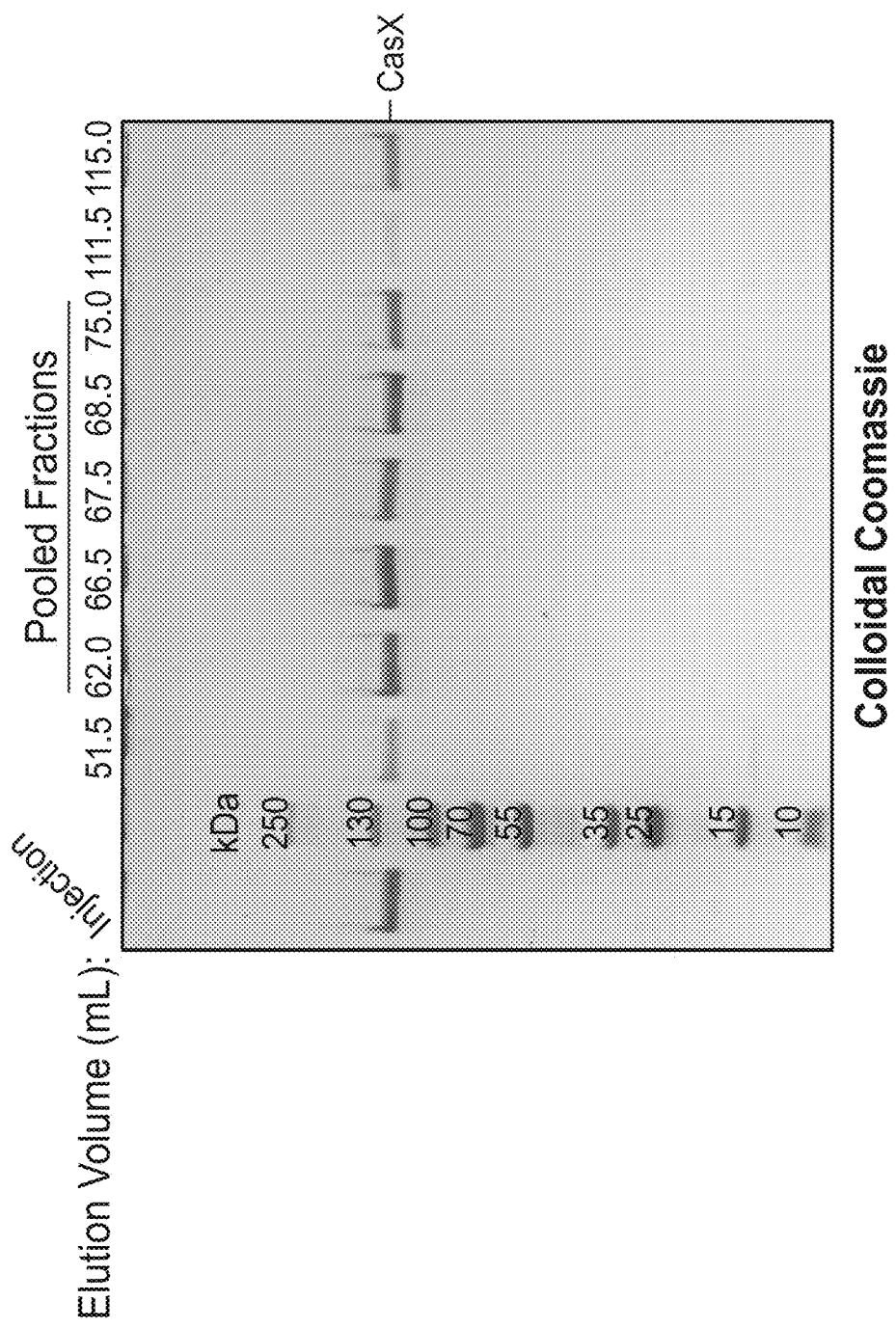
FIG. 28 shows an SDS-PAGE gel of CasX 119 purification fractions visualized by colloidal Coomassie staining, as described in Example 8. Samples from the indicated fractions were resolved by SDS-PAGE and stained with colloidal Coomassie. From right to left, Injection: sample of protein injected onto the gel filtration column, molecular weight markers, lanes 3-10: samples from the indicated elution volumes.

CasX Variant 119: Following the same expression and purification scheme for WT CasX, the following results were obtained for CasX variant 119. Samples from throughout the purification procedure were resolved by SDS-PAGE and visualized by colloidal Coomassie staining, as shown in FIG. 28. Results from the gel filtration are shown in FIG. 27. The average yield was 11.7 mg of purified CasX protein per liter of culture at 95% purity, as evaluated by colloidal Coomassie staining.

Figure 29:
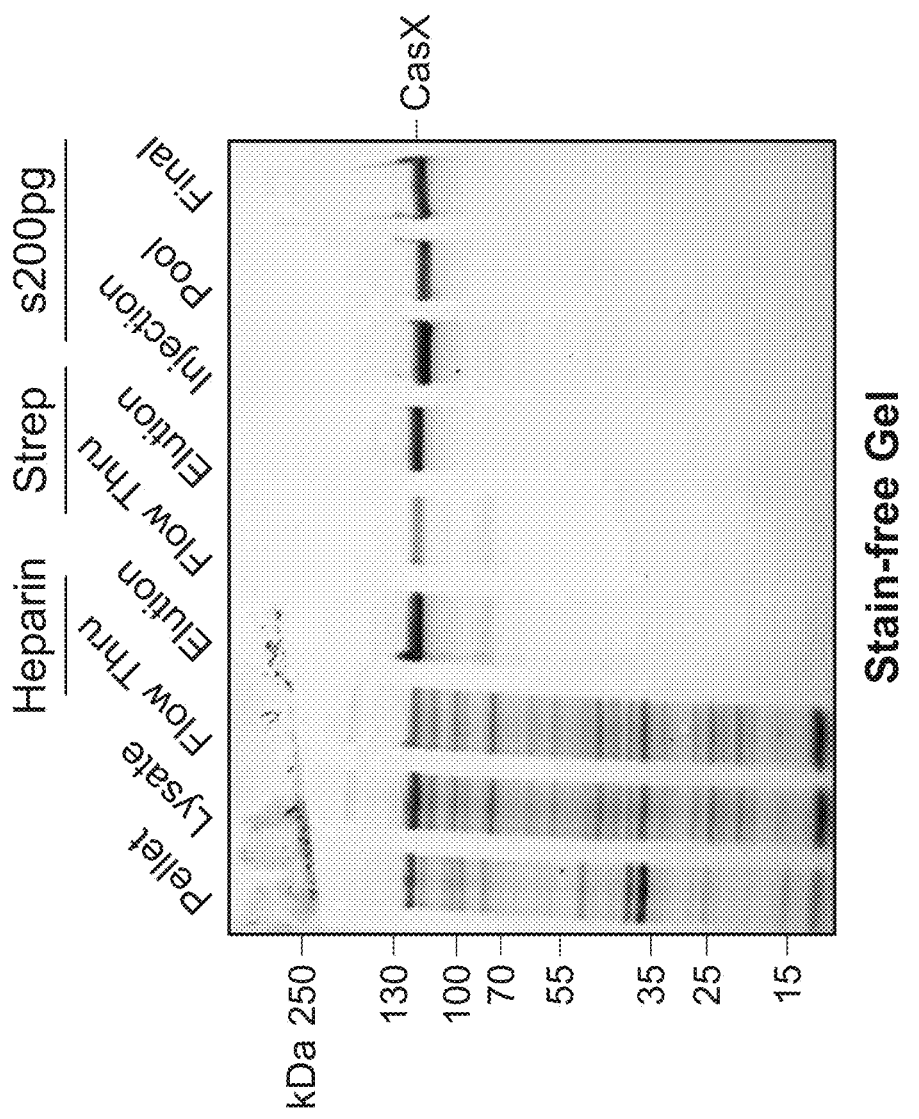
FIG. 29 shows an SDS-PAGE gel of purification samples of CasX 438, visualized on a Bio-Rad Stain-Free™ gel. The lanes, from left to right, are: Pellet: insoluble portion following cell lysis, Lysate: soluble portion following cell lysis, Flow Thru: protein that did not bind the heparin column, Elution: protein eluted from the heparin column with elution buffer, Flow Thru: Protein that did not bind the StrepTactin column, Elution: protein eluted from the StrepTactin column with elution buffer, Injection: concentrated protein injected onto the s200 gel filtration column, Pool: pooled CasX-containing fractions, Final: pooled fractions from the s200 elution that have been concentrated and frozen.
Figure 30:
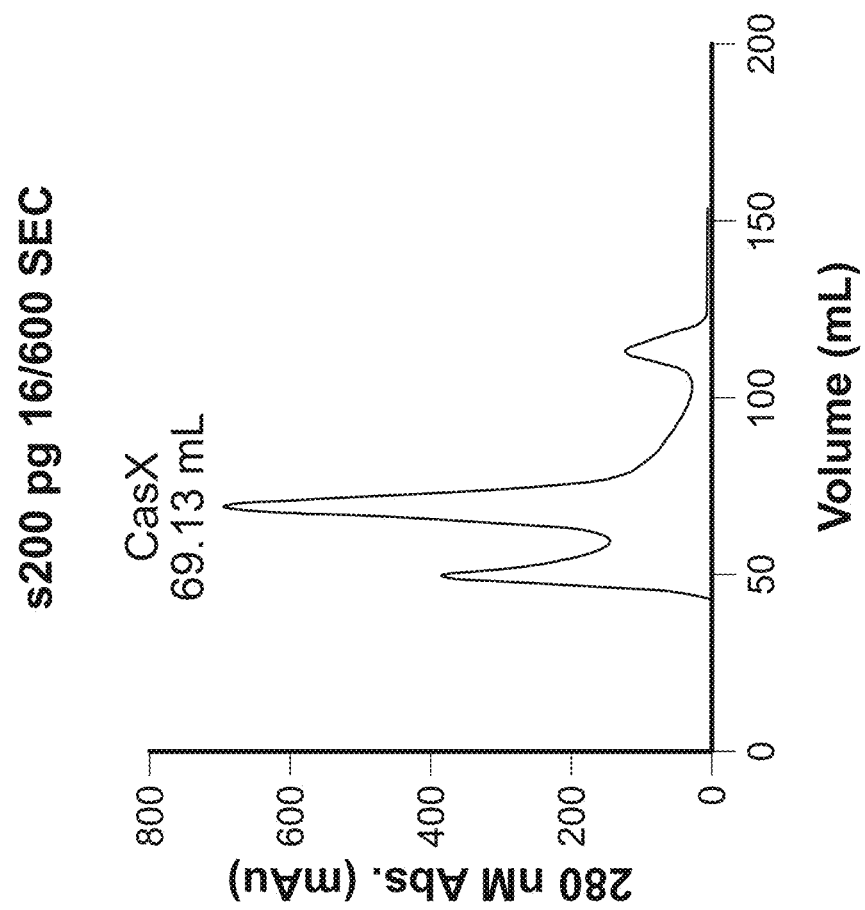
FIG. 30 shows the chromatogram from a size exclusion chromatography assay of the CasX 438, using of Superdex 200 16/600 pg gel filtration, as described in Example 8. The 69.13 mL peak corresponds to the apparent molecular weight of CasX variant 438 and contained the majority of CasX variant 438 protein.
Figure 31:
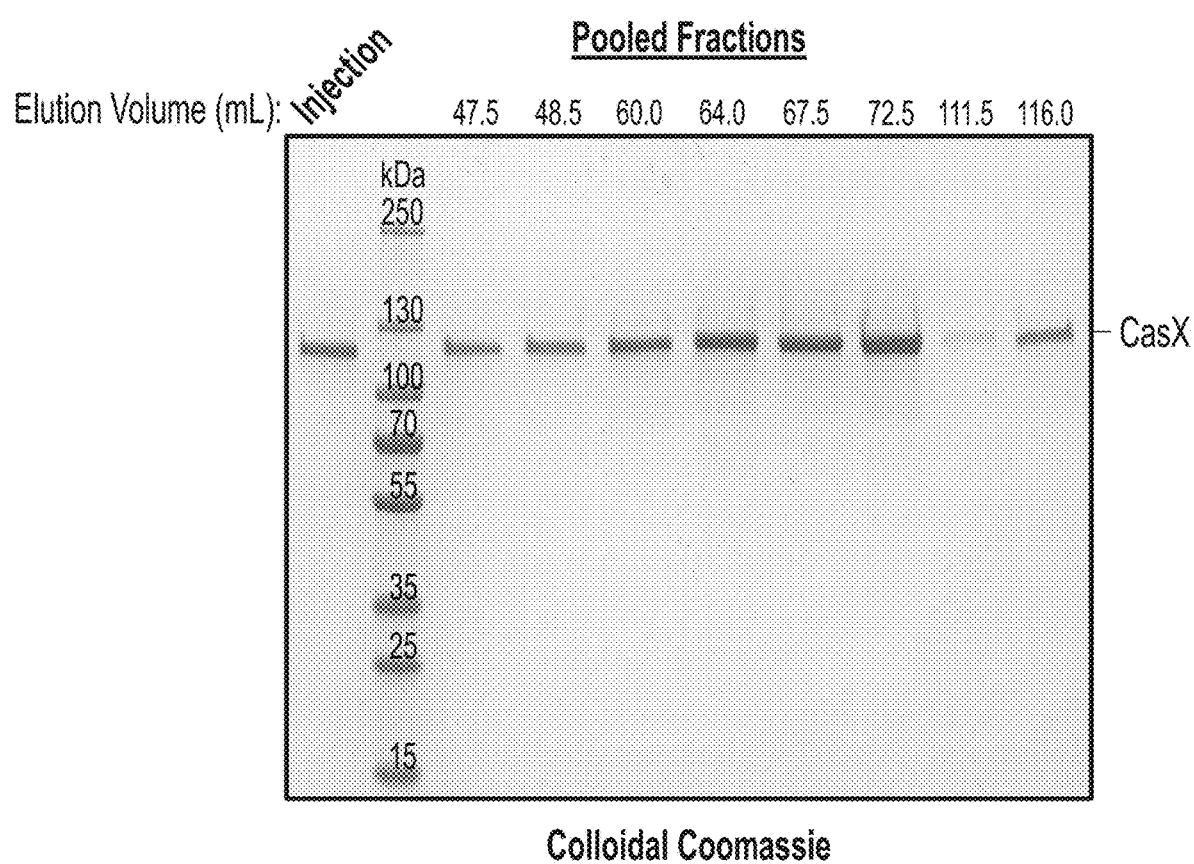
FIG. 31 shows an SDS-PAGE gel of CasX 438 purification fractions visualized by colloidal Coomassie staining, as described in Example 8. Samples from the indicated fractions were resolved by SDS-PAGE and stained with colloidal Coomassie. From right to left, Injection: sample of protein injected onto the gel filtration column, molecular weight markers, lanes 3-10: samples from the indicated elution volumes.

CasX Variant 438: Following the same expression and purification scheme for WT CasX, the following results were obtained for CasX variant 438. Samples from throughout the purification procedure were resolved by SDS-PAGE and visualized by colloidal Coomassie staining, as shown in FIGS. 29 and 31. Results from the gel filtration are shown in FIG. 30. The average yield was 13.1 mg of purified CasX protein per liter of culture at 97.5% purity, as evaluated by colloidal Coomassie staining.

Figure 32:
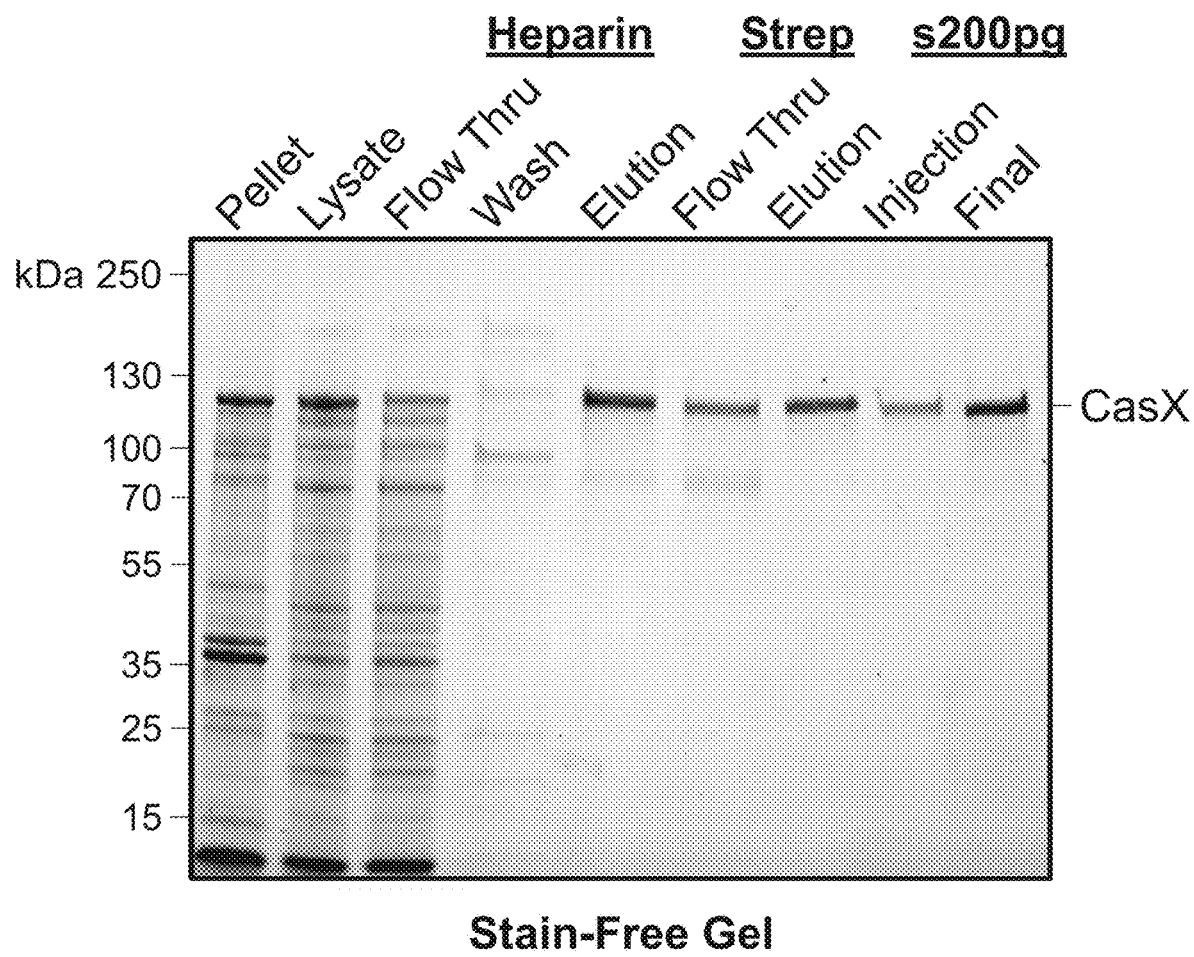
FIG. 32 shows an SDS-PAGE gel of purification samples of CasX 457, visualized on a Bio-Rad Stain-Free™ gel. The lanes, from left to right, are: Pellet: insoluble portion following cell lysis, Lysate: soluble portion following cell lysis, Flow Thru: protein that did not bind the heparin column, Wash, Elution: protein eluted from the heparin column with elution buffer, Flow Thru: Protein that did not bind the StrepTactin column, Elution: protein eluted from the StrepTactin column with elution buffer, Injection: concentrated protein injected onto the s200 gel filtration column, Final: pooled fractions from the s200 elution that have been concentrated and frozen.
Figure 33:
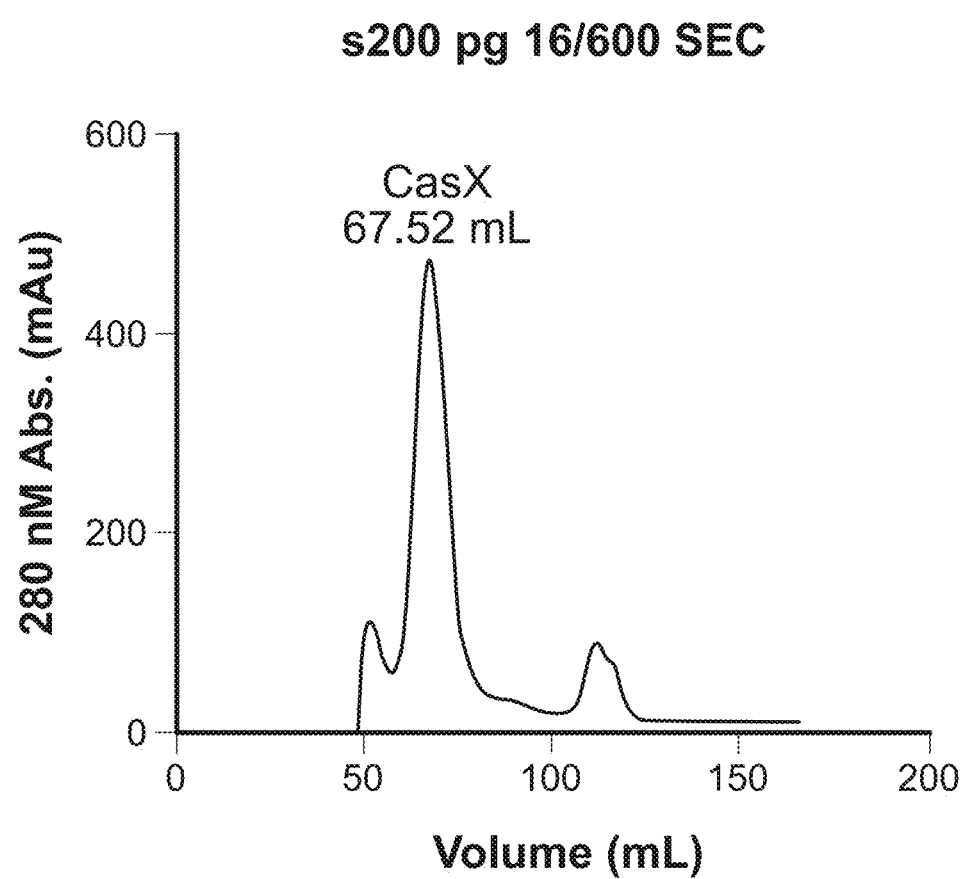
FIG. 33 shows the chromatogram from a size exclusion chromatography assay of the CasX 457, using of Superdex 200 16/600 pg gel filtration, as described in Example 8. The 67.52 mL peak corresponds to the apparent molecular weight of CasX variant 457 and contained the majority of CasX variant 457 protein.
Figure 34:
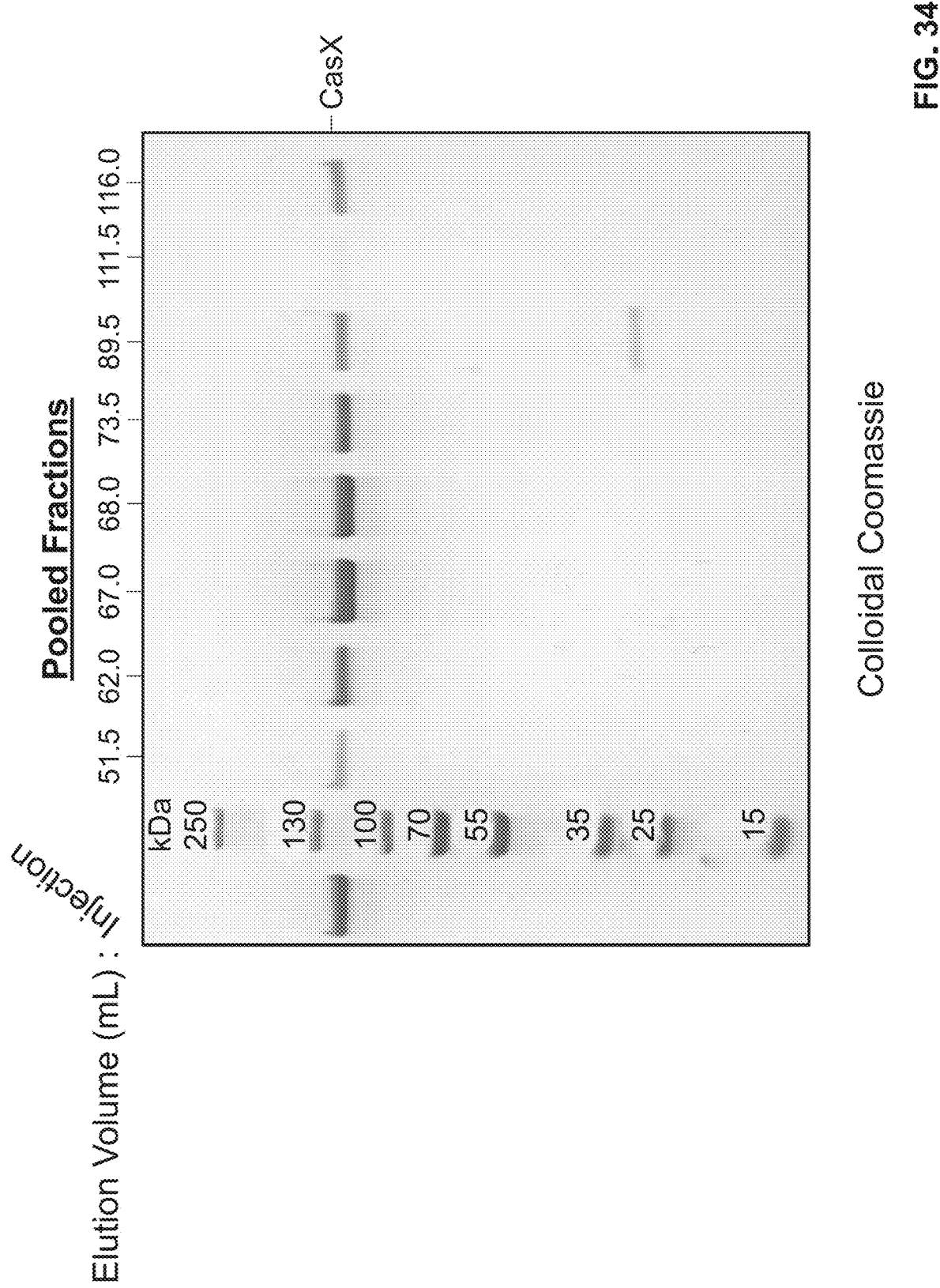
FIG. 34 shows an SDS-PAGE gel of CasX 457 purification fractions visualized by colloidal Coomassie staining, as described in Example 8. Samples from the indicated fractions were resolved by SDS-PAGE and stained with colloidal Coomassie. From right to left, Injection: sample of protein injected onto the gel filtration column, molecular weight markers, lanes 3-10: samples from the indicated elution volumes.

CasX Variant 457: Following the same expression and purification scheme for WT CasX, the following results were obtained for CasX variant 457. Samples from throughout the purification procedure were resolved by SDS-PAGE and visualized by colloidal Coomassie staining, as shown in FIGS. 32 and 34. Results from the gel filtration are shown in FIG. 33. The average yield was 9.76 mg of purified CasX protein per liter of culture at 91.6% purity, as evaluated by colloidal Coomassie staining.

Overall, the results support that CasX variants can be produced and recovered at high levels of purity sufficient for experimental assays and evaluation.

Example 9: Design and Generation of CasX 119, 438 and 457

Figure 35:
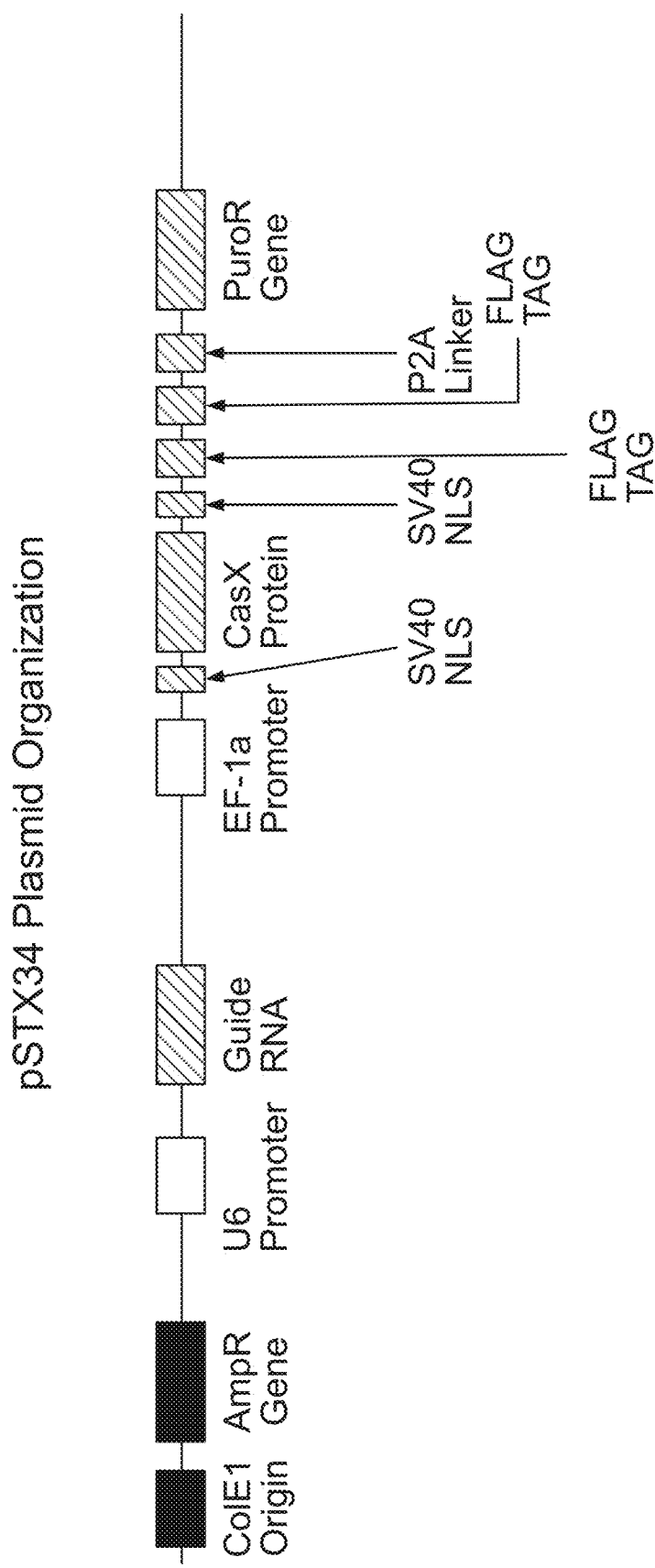
FIG. 35 is a schematic showing the organization of the components in the pSTX34 plasmid used to assemble the CasX constructs, as described in Example 9.
Figure 36:
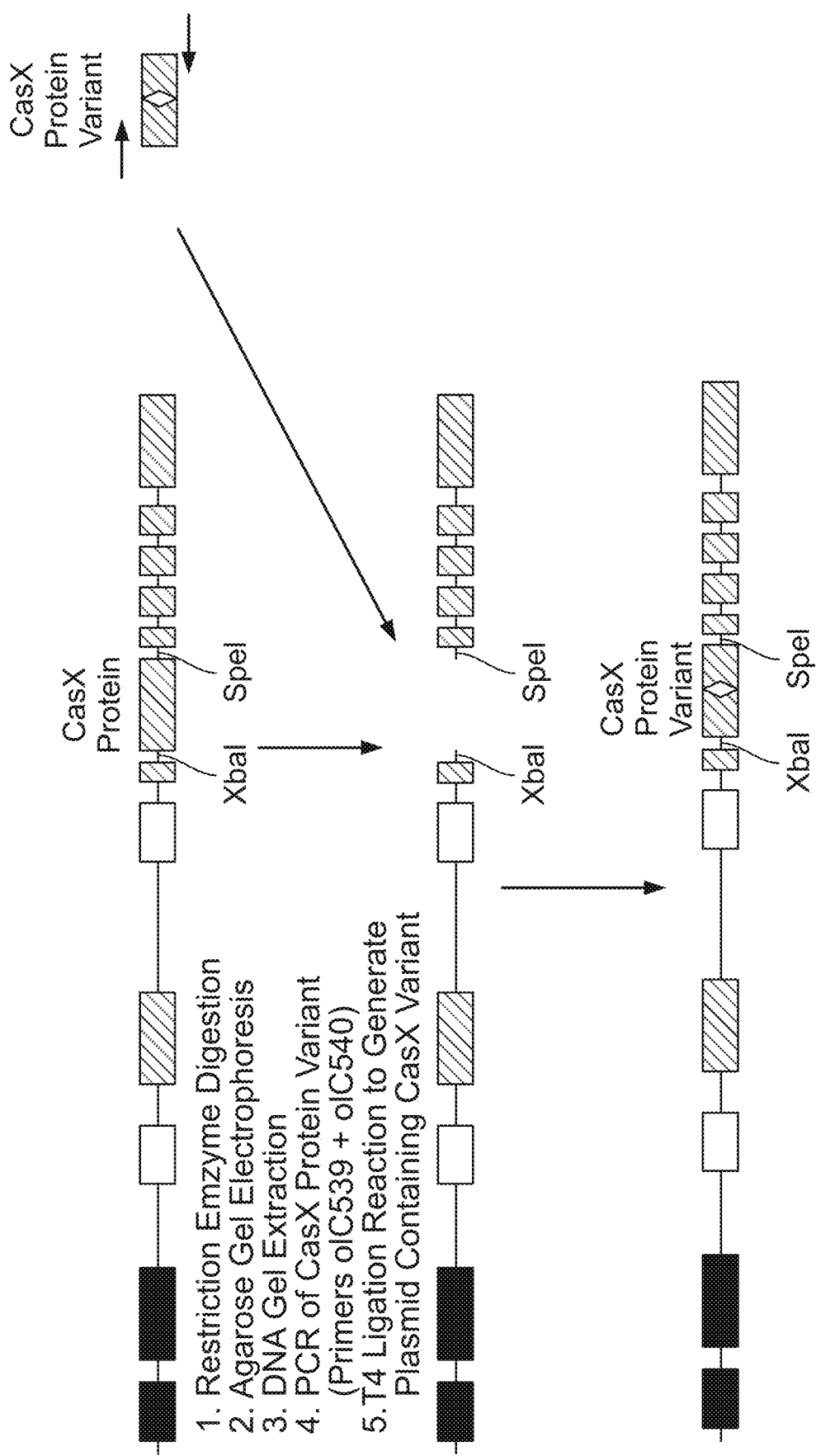
FIG. 36 is a schematic showing the steps of generating the CasX 119 variant, as described in Example 9.

In order to generate the CasX 119, 438, and 457 constructs (sequences in Table 9), the codon-optimized CasX 37 construct (based on the WT CasX Stx2 construct of Example 8, encoding Planctomycetes CasX SEQ ID NO: 2, with a A708K substitution and a [P793] deletion with fused NLS, and linked guide and non-targeting sequences) was cloned into a mammalian expression plasmid (pStX; see FIG. 35) using standard cloning methods. To build CasX 119, the CasX 37 construct DNA was PCR amplified in two reactions using Q5 DNA polymerase (New England BioLabs Cat #M0491L) according to the manufacturer's protocol, using primers oIC539 and oIC88 as well as oIC87 and oIC540 respectively (see FIG. 36). To build CasX 457, the CasX 365 construct DNA was PCR amplified in four reactions using Q5 DNA polymerase (New England BioLabs Cat #M0491L) according to the manufacturer's protocol, using primers oIC539 and oIC212, oIC211 and oIC376, oIC375 and oIC551, and oIC550 and oIC540 respectively. To build CasX 438, the CasX 119 construct DNA was PCR amplified in four reactions using Q5 DNA polymerase (New England BioLabs Cat #M0491L) according to the manufacturer's protocol, using primers oIC539 and oIC689, oIC688 and oIC376, oIC375 and oIC551, and oIC550 and oIC540 respectively. The resulting PCR amplification products were then purified using Zymoclean™ DNA clean and concentrator (Zymo Research Cat #4014) according to the manufacturer's protocol. The pStX backbone was digested using XbaI and SpeI in order to remove the 2931 base pair fragment of DNA between the two sites in plasmid pStx34. The digested backbone fragment was purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson Assembly® (New England BioLabs Cat #E2621S) following the manufacturer's protocol. Assembled products in the pStx34 were transformed into chemically-competent Turbo Competent E. coli bacterial cells, plated on LB-Agar plates (LB: Teknova Cat #L9315, Agar: Quartzy Cat #214510) containing carbenicillin. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. pStX34 includes an EF-1t promoter for the protein as well as a selection marker for both puromycin and carbenicillin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent E. coli (NEB Cat #C2984I), plated on LB-Agar plates (LB: Teknova Cat #L9315, Agar: Quartzy Cat #214510) containing carbenicillin. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX proteins was performed as described in Example 8, however in that Example, the DNA sequences were codon optimized for expression in E. coli.

TABLE 9

Sequences of CasX 119, 438 and 457

| Construct | DNA [SEQ ID NO] | Protein [SEQ ID NO] |
| --- | --- | --- |
| CasX 119 | 3502 | 3505 |
| CasX 457 | 3503 | 3506 |
| CasX 438 | 3504 | 3507 |

Example 10: Design and Generation of CasX Constructs 278-280, 285-288, 290, 291, 293, 300, 492, and 493

In order to generate the CasX 278-280, 285-288, 290, 291, 293, 300, 492, and 493 constructs (sequences in Table 10), the N- and C-termini of the codon-optimized CasX 119 construct (based on the CasX Stx37 construct of Example 9, encoding Planctomycetes CasX SEQ ID NO: 2, with a A708K substitution and a [P793] deletion with fused NLS, and linked guide and non-targeting sequences) in a mammalian expression vector were manipulated to delete or add NLS sequences (sequences in Table 11). Constructs 278, 279, and 280 were manipulations of the N- and C-termini using only an SV40 NLS sequence. Construct 280 had no NLS on the N-terminus and added two SV40 NLS' on the C-terminus with a triple proline linker in between the two SV40 NLS sequences. Constructs 278, 279, and 280 were made by amplifying pStx34.119.174.NT with Q5 DNA polymerase (New England BioLabs Cat #M0491L) according to the manufacturer's protocol, using primers oIC527 and oIC528, oIC730 and oIC522, and oIC730 and oIC530 for the first fragments each and using oIC529 and oIC520, oIC519 and oIC731, and oIC529 and oIC731 to create the second fragments each. These fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The respective fragments were cloned together using Gibson Assembly® (New England BioLabs Cat

E2621S) following the manufacturer's protocol. Assembled products in the pStx34 were transformed into chemically-competent Turbo Competent *E. coli* bacterial cells, plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation.

In order to generate constructs 285-288, 290, 291, 293, and 300, a nested PCR method was used for cloning. The backbone vector and PCR template used was construct pStx34 279.119.174.NT, having the CasX 119, guide 174, and non-targeting spacer (see Examples 8 and 9 and Tables therein for sequences). Construct 278 has the configuration SV40NLS-CasX119. Construct 279 has the configuration CasX119-SV40NLS. Construct 280 has the configuration CasX119-SV40NLS-PPP linker-SV40NLS. Construct 285 has the configuration CasX119-SV40NLS-PPP linker-SynthNLS3. Construct 286 has the configuration CasX119-SV40NLS-PPP linker-SynthNLS4. Construct 287 has the configuration CasX119-SV40NLS-PPP linker-SynthNLS5. Construct 288 has the configuration CasX119-SV40NLS-PPP linker-SynthNLS6. Construct 290 has the configuration CasX119-SV40NLS-PPP linker-EGL-13 NLS. Construct 291 has the configuration CasX119-SV40NLS-PPP linker-c-Myc NLS. Construct 293 has the configuration CasX119-SV40NLS-PPP linker-Nucleolar RNA Helicase II NLS. Construct 300 has the configuration CasX119-SV40NLS-PPP linker-Influenza A protein NLS. Construct 492 has the configuration SV40NLS-CasX119- SV40NLS-PPP linker-SV40NLS. Construct 493 has the configuration SV40NLS-CasX119- SV40NLS-PPP linker-c-Myc NLS. Each variant had a set of three PCRs; two of which were nested, were purified by gel extraction, digested, and then ligated into the digested and purified backbone. Assembled products in the pStx34 were transformed into chemically-competent Turbo Competent *E. coli* bacterial cells, plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into the resulting pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation.

In order to generate constructs 492 and 493, constructs 280 and 291 were digested using XbaI and BamHI (NEB #R0145S and NEB #R3136S) according to the manufacturer's protocol. Next, they were purified by gel extraction from a 1% agarose gel (Gold Bio Cat #A-201-500) using Zymoclean™ Gel DNA Recovery Kit (Zymo Research Cat #D4002) according to the manufacturer's protocol. Finally, they were ligated using T4 DNA ligase (NEB #M0202S) according to the manufacturer's protocol into the digested and purified pStx34.119.174.NT using XbaI and BamHI and Zymoclean™ Gel DNA Recovery Kit. Assembled products in the pStx34 were transformed into chemically-competent Turbo Competent *E. coli* bacterial cells, plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Sequences encoding the targeting spacer sequences that target the gene of interest were designed based on CasX PAM locations. Targeting sequence DNA was ordered as single-stranded DNA (ssDNA) oligos (Integrated DNA Technologies) consisting of the targeting spacer sequence and the reverse complement of this sequence. These two oligos were annealed together and cloned into each pStX individually or in bulk by Golden Gate assembly using T4 DNA Ligase (New England BioLabs Cat #M0202L) and an appropriate restriction enzyme for the respective plasmids. Golden Gate products were transformed into chemically- or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation. The plasmids would be used to produce and recover CasX protein utilizing the general methodologies of Examples 8 and 9.

TABLE 10

CasX 278-280, 285-288, 290, 291, 293, 300, 492, and 493 constructs and corresponding Seq ID NOs

| Construct | SEQ ID NO |
| --- | --- |
| 278 | 3508 |
| 279 | 3509 |
| 280 | 3510 |
| 285 | 3511 |

TABLE 10-continued

CasX 278-280, 285-288, 290, 291, 293, 300, 492, and 493 constructs and corresponding Seq ID NOs

| Construct | SEQ ID NO |
|---|---|
| 286 | 3512 |
| 287 | 3513 |
| 288 | 3514 |
| 290 | 3515 |
| 291 | 3516 |
| 293 | 3517 |
| 300 | 3518 |
| 492 | 3519 |
| 493 | 3520 |

TABLE 11

Nuclear localization sequence list

| CasX | NLS | SEQ ID NO | DNA Sequence | SEQ ID NO | Amino Acid Sequence |
|---|---|---|---|---|---|
| 278, 279, 280, 492, 493 | SV40 | 3521 | CCAAAGAAGAAGCGG AAGGTC | 352 | PKKKRKV |
| 285 | SynthNLS3 | 3522 | CACAAGAAGAAACAT CCAGACGCATCAGTCA ACTTTAGCGAGTTCAG TAAA | 383 | HKKKHPDASVNIFS EFSK |
| 286 | SynthNLS4 | 3523 | CAGCGCCCTGGGCCTT ACGATAGGCCGCAAA GACCCGGACCGTATGA TCGCCCT | 394 | QRPGPYDRPQRPG PYDRP |
| 287 | SynthNLS5 | 3524 | CTCAGCCCGAGTCTTA GTCCACTGCTTTCCCC GTCCCTGTCTCCACTG | 385 | LSPSLSPLLSPS LSPL |
| 288 | SynthNLS6 | 3525 | CGGGGCAAGGGTGGC AAGGGGCTTGGCAAG GGGGGGGCAAAGAGG CACAGGAAG | 386 | RGKGGKGLGIK GGAKRHRK |
| 290 | EGL-13 | 3526 | AGCCGCCGCAGAAAA GCCAATCCTACAAAAC TGTCAGAAAATGCGA AAAAACTTGCTAAGG AGGTGGAAAAC | 379 | SRRRKANPTKL SENAKKLAKE VEN |
| 291 | c-Myc | 3527 | CCTGCCGCAAAGCGA GTGAAATTGGAC | 354 | PAAKRVKLD |
| 293 | Nucleolar RNA Helicase II | 3528 | AAGCGGTCCTTCAGTA AGGCCTTT | 375 | KRSFSKAF |
| 300 | Influenza A protein | 3529 | AAACGGGGAATAAAC GACCGGAACTTCTGGC GCGGGGAAAACGAGC GCAAACCCGA | 373 | KRGINDRNIW RGENERKTR |

Example 11: Design and Generation of CasX Constructs 387, 395, 485-491, and 494

In order to generate CasX 395, CasX 485, CasX 486, CasX 487, the codon optimized CasX 119 (based on the CasX 37 construct of Example 9, encoding Planctomycetes CasX SEQ ID NO: 2, with a A708K substitution and a [P793] deletion with fused NLS, and linked guide and non-targeting sequences), CasX 435, CasX 438, and CasX 484 (each based on CasX 119 construct of Example 9 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector comprising a KanR marker, colE1 on, and CasX with fused NLS (pStx1) using standard cloning methods. Gibson primers were designed to amplify the CasX SEQ ID NO: 1 Helical I domain from amino acid 192-331 in its own vector to replace this corresponding region (aa 193-332) on CasX 119, CasX 435, CasX 438, and CasX 484 in pStx1 respectively. The Helical I domain from CasX SEQ ID NO: 1 was amplified with primers oIC768 and oIC784 using Q5 DNA polymerase (New England BioLabs Cat #M0491L) according to the manufacturer's protocol. The destination vector containing the desired CasX variant was amplified with primers oIC765 and oIC764 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson Assembly® (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (pStX; see FIG. 36) using standard cloning methods. The resultant plasmids were sequenced using Sanger sequencing to ensure correct assembly. Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct ligation.

In order to generate CasX 488, CasX 489, CasX 490, and CasX 491 (sequences in Table 12), the codon optimized CasX 119 (based on the CasX 37 construct of Example 9, encoding Planctomycetes CasX SEQ ID NO: 2, with a A708K substitution and a [P793] deletion with fused NLS, and linked guide and non-targeting sequences), CasX 435, CasX 438, and CasX 484 (each based on CasX119 construct of Example 9 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector that was made up of a KanR marker, colE1 on, and STX with fused NLS (pStx1) using standard cloning methods. Gibson primers were designed to amplify the CasX Stx1 NTSB domain from amino acid 101-191 and Helical I domain from amino acid 192-331 in its own vector to replace this similar region (aa 103-332) on CasX 119, CasX 435, CasX 438, and CasX 484 in pStx1 respectively. The NTSB and Helical I domain from CasX SEQ ID NO: 1 were amplified with primers oIC766 and oIC784 using Q5 DNA polymerase (New England BioLabs Cat #M0491L) according to the manufacturer's protocol. The destination vector containing the desired CasX variant was amplified with primers oIC762 and oIC765 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson Assembly® (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (pStX; see FIG. 36) using standard cloning methods. The resultant plasmids were sequenced using Sanger sequencing to ensure correct assembly. Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation.

In order to generate CasX 387 and CasX 494 (sequences in Table 12), the codon optimized CasX 119 (based on the CasX 37 construct of Example 9, encoding Planctomycetes CasX SEQ ID NO: 2, with a A708K substitution and a [P793] deletion with fused NLS, and linked guide and non-targeting sequences) and CasX 484 (based on CasX119 construct of Example 9 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector that was made up of a KanR marker, colE1 ori, and STX with fused NLS (pStx1) using standard cloning methods. Gibson primers were designed to amplify the CasX Stx1 NTSB domain from amino acid 101-191 in its own vector to replace this similar region (aa 103-192) on CasX 119 and CasX 484 in pStx1 respectively. The NTSB domain from CasX Stx1 was amplified with primers oIC766 and oIC767 using Q5 DNA polymerase (New England BioLabs Cat #M0491L) according to the manufacturer's protocol. The destination vector containing the desired CasX variant was amplified with primers oIC763 and oIC762 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson Assembly® (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (pStX; see FIG. 36) using standard cloning methods. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent E. coli (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation. Sequences of the resulting constructs are listed in Table 12.

TABLE 12

CasX 395 and 485-491 constructs and corresponding SEQ ID NOs

| Construct | DNA [SEQ ID NO] | Protein [SEQ ID NO] |
|---|---|---|
| CasX 387 | 3530 | 3540 |
| CasX 395 | 3531 | 3541 |
| CasX 485 | 3532 | 3542 |
| CasX 486 | 3533 | 3543 |
| CasX 487 | 3534 | 3544 |
| CasX 488 | 3535 | 3545 |
| CasX 489 | 3536 | 3546 |
| CasX 490 | 3537 | 3547 |
| CasX 491 | 3538 | 3548 |
| CasX 494 | 3539 | 3549 |

Example 12: Generation of RNA Guides

For the generation of RNA single guides and spacers, templates for in vitro transcription were generated by performing PCR with Q5 polymerase (NEB M0491) according to the recommended protocol, with template oligos for each backbone and amplification primers with the T7 promoter and the spacer sequence. The DNA primer sequences for the T7 promoter, guide and spacer for guides and spacers are presented in Table 13, below. The template oligos, labeled "backbone fwd" and "backbone rev" for each scaffold, were included at a final concentration of 20 nM each, and the amplification primers (T7 promoter and the unique spacer primer) were included at a final concentration of 1 uM each. The sg2, sg32, sg64, and sg174 guides correspond to SEQ ID NOS: 5, 2104, 2106, and 2238, respectively, with the exception that sg2, sg32, and sg64 were modified with an additional 5' G to increase transcription efficiency (compare sequences in Table 13 to Table 2). The 7.37 spacer targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM $MgCl_2$, 0.01% Triton™ X-100, 2 mM spermidine, 20 mM DTT, 5 mM NTPs, 0.5 µM template, and 100 µg/mL T7 RNA polymerase. Reactions were incubated at 37° C. overnight. 20 units of DNase I (Promega #M6101)) were added per 1 mL of transcription volume and incubated for one hour. RNA products were purified via denaturing PAGE, ethanol precipitated, and resuspended in 1× phosphate buffered saline. To fold the sgRNAs, samples were heated to 70° C. for 5 min and then cooled to room temperature. The reactions were supplemented to 1 mM final $MgCl_2$ concentration, heated to 50° C. for 5 min and then cooled to room temperature. Final RNA guide products were stored at −80° C.

TABLE 13

Sequences for generation of guide RNA

| Primer | Primer Sequence (SEQ ID NO) | RNA Product (SEQ ID NO) | RNA product |
|---|---|---|---|
| T7 promoter primer | 3550 | NA | Used for all |
| sg2 backbone fwd | 3551 | 3563 | GGUACUGGCGCUUUUAUCUCAUUACUU |
| sg2 backbone rev | 3552 | | UGAGAGCCAUCACCAGCGACUAUGUCG |
| sg2.7.37 spacer primer | 3553 | | UAUGGGUAAAGCGCUUAUUUAUCGGAG AGAAAUCCGAUAAAUAAGAAGCAUCAA AGGGCCGAGAUGUCUCGCUCCG |
| sg32 backbone fwd | 3554 | 3564 | GGUACUGGCGCUUUUAUCUCAUUACUU |
| sg32 backbone rev | 3555 | | UGAGAGCCAUCACCAGCGACUAUGUCG |
| sG32.7.37 spacer primer | 3556 | | UAUGGGUAAAGCGCCCUCUUCGGAGGG AAGCAUCAAAGGGCCGAGAUGUCUCG |
| sg64 backbone fwd | 3557 | 3565 | GGUACUGGCGCCUUUAUCUCAUUACUU |
| sg64 backbone rev | 3558 | | UGAGAGCCAUCACCAGCGACUAUGUCG |
| sg64.7.37 spacer primer | 3559 | | UAUGGGUAAAGCGCUUACGGACUUCGG UCCGUAAGAAGCAUCAAAGGGCCGAGA UGUCUCGCUCCG |
| sg174 backbone fwd | 3560 | 3566 | ACUGGCGCUUUUAUCUgAUUACUUUGA |
| sg174 backbone rev | 3561 | | GAGCCAUCACCAGCGACUAUGUCGUAg |
| sg174.7.37 spacer primer | 3562 | | UGGGUAAAGCUCCCUCUUCGGAGGGAG CAUCAAAGGGCCGAGAUGUCUCGCUCC G |

Example 13: RNP Assembly

Purified wild-type and RNP of CasX and single guide RNA (sgRNA) were either prepared immediately before experiments or prepared and snap-frozen in liquid nitrogen and stored at −80° C. for later use. To prepare the RNP complexes, the CasX protein was incubated with sgRNA at 1:1.2 molar ratio. Briefly, sgRNA was added to Buffer #1 (25 mM NaPi, 150 mM NaCl, 200 mM trehalose, 1 mM MgCl$_2$), then the CasX was added to the sgRNA solution, slowly with swirling, and incubated at 37° C. for 10 min to form RNP complexes. RNP complexes were filtered before use through a 0.22 µm Costar 8160 filters that were pre-wet with 200 µl Buffer #1. If needed, the RNP sample was concentrated with a 0.5 ml Ultra 100-Kd cutoff filter, (Millipore part #UFC510096), until the desired volume was obtained. Formation of competent RNP was assessed as described in Example 19.

Example 14: Assessing Binding Affinity to the Guide RNA

Purified wild-type and improved CasX will be incubated with synthetic single-guide RNA containing a 3' Cy7.5 moiety in low-salt buffer containing magnesium chloride as well as heparin to prevent non-specific binding and aggregation. The sgRNA will be maintained at a concentration of 10 µM, while the protein will be titrated from 1 µM to 100 µM in separate binding reactions. After allowing the reaction to come to equilibrium, the samples will be run through a vacuum manifold filter-binding assay with a nitrocellulose membrane and a positively charged nylon membrane, which bind protein and nucleic acid, respectively. The membranes will be imaged to identify guide RNA, and the fraction of bound vs unbound RNA will be determined by the amount of fluorescence on the nitrocellulose vs nylon membrane for each protein concentration to calculate the dissociation constant of the protein-sgRNA complex. The experiment will also be carried out with improved variants of the sgRNA to determine if these mutations also affect the affinity of the guide for the wild-type and mutant proteins. We will also perform electromobility shift assays to qualitatively compare to the filter-binding assay and confirm that soluble binding, rather than aggregation, is the primary contributor to protein-RNA association.

Example 15: Assessing Binding Affinity to the Target DNA

Purified wild-type and improved CasX will be complexed with single-guide RNA bearing a targeting sequence complementary to the target nucleic acid. The RNP complex will be incubated with double-stranded target DNA containing a PAM and the appropriate target nucleic acid sequence with a 5' Cy7.5 label on the target strand in low-salt buffer containing magnesium chloride as well as heparin to prevent non-specific binding and aggregation. The target DNA will be maintained at a concentration of 1 nM, while the RNP will be titrated from 1 µM to 100 µM in separate binding reactions. After allowing the reaction to come to equilibrium, the samples will be run on a native 5% polyacrylamide gel to separate bound and unbound target DNA. The gel will be imaged to identify mobility shifts of the target DNA, and the fraction of bound vs unbound DNA will be calculated for each protein concentration to determine the dissociation constant of the RNP-target DNA ternary complex.

Example 16: Assessing Differential PAM Recognition In Vitro

Purified wild-type and engineered CasX variants will be complexed with single-guide RNA bearing a fixed targeting sequence. The RNP complexes will be added to buffer containing MgCl$_2$ at a final concentration of 100 nM and incubated with 5' Cy7.5-labeled double-stranded target DNA at a concentration of 10 nM. Separate reactions will be carried out with different DNA substrates containing different PAMs adjacent to the target nucleic acid sequence. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the rate of cleavage of the non-canonical PAMs by the CasX variants will be determined.

Example 17: Assessing Nuclease Activity for Double-Strand Cleavage

Purified wild-type and engineered CasX variants will be complexed with single-guide RNA bearing a fixed PM22 targeting sequence. The RNP complexes will be added to buffer containing MgCl$_2$ at a final concentration of 100 nM and incubated with double-stranded target DNA with a 5' Cy7.5 label on either the target or non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of the target and non-target strands by the wild-type and engineered variants will be determined. To more clearly differentiate between changes to target binding vs the rate of catalysis of the nucleolytic reaction itself, the protein concentration will be titrated over a range from 10 nM to 1 uM and cleavage rates will be determined at each concentration to generate a pseudo-Michaelis-Menten fit and determine the kcat* and KM*. Changes to KM* are indicative of altered binding, while changes to kcat* are indicative of altered catalysis.

Example 18: Assessing Target Strand Loading for Cleavage

Purified wild-type and engineered CasX 119 will be complexed with single-guide RNA bearing a fixed PM22 targeting sequence. The RNP complexes will be added to buffer containing MgCl$_2$ at a final concentration of 100 nM and incubated with double-stranded target DNA with a 5' Cy7.5 label on the target strand and a 5' Cy5 label on the non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of both strands by the variants will be determined. Changes to the rate of target strand cleavage but not non-target strand cleavage would be indicative of improvements to the loading of the target strand in the active site for cleavage. This activity could be further isolated by repeating the assay with a dsDNA substrate that has a gap on the non-target strand, mimicking a pre-cleaved substrate. Improved cleavage of the non-target strand in this context would give further evidence that the loading and cleavage of the target strand, rather than an upstream step, has been improved.

Example 19: CasX:gNA In Vitro Cleavage Assays

1. Determining Cleavage-Competent Fraction

The ability of CasX variants to form active RNP compared to reference CasX was determined using an in vitro cleavage assay. The beta-2 microglobulin (B2M) 7.37 target for the cleavage assay was created as follows. DNA oligos with the sequence TGAAGCTGACAGCATTCGGGCCG-AGATGTCTCGCTCCGTGGCCTTAGCTGTGCTC GC-GCT (non-target strand, NTS; SEQ ID NO: 3567) and TGAAGCTGACAGCATTCGGGCCGAGATGTCTCG-CTCCGTGGCCTTAGCTGTGCTC GCGCT (target strand, TS; SEQ ID NO: 3568) were purchased with 5' fluorescent labels (LI-COR IRDye 700 and 800, respectively). dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM $MgCl_2$), heating to 95° C. for 10 minutes, and allowing the solution to cool to room temperature.

CasX RNPs were reconstituted with the indicated CasX and guides (see graphs) at a final concentration of 1 µM with 1.5-fold excess of the indicated guide in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. The 7.37 target was used, along with sgRNAs having spacers complementary to the 7.37 target.

Figure 37:
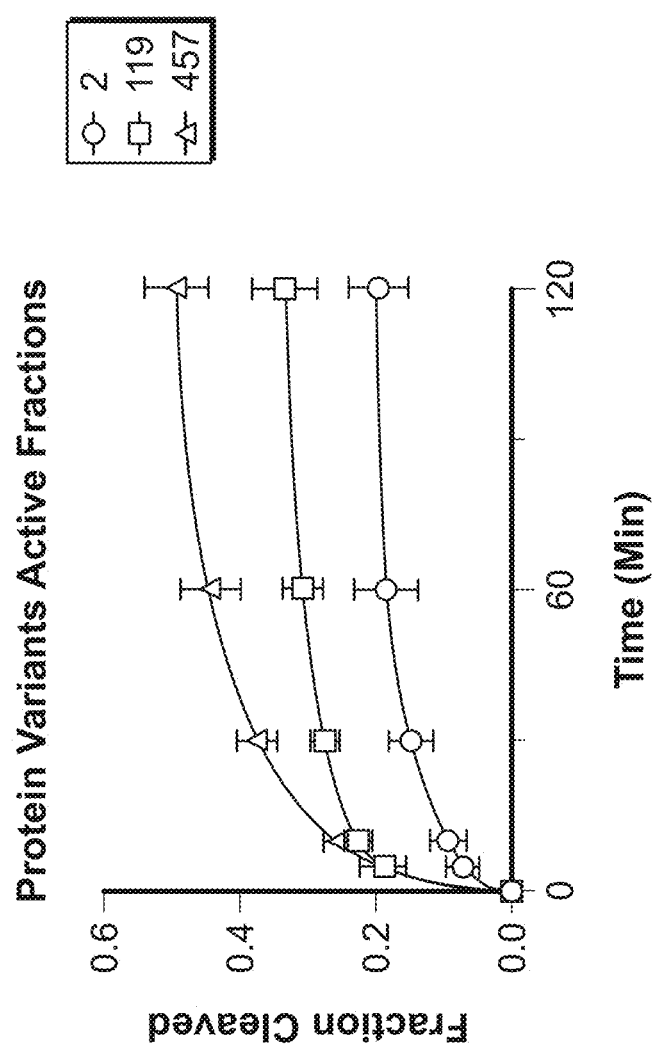
FIG. 37 is a graph of the results of an assay for the quantification of active fractions of RNP formed by sgRNA174 and the CasX variants 119 and 457, as described in Example 19. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to the reference CasX protein of SEQ ID NO: 2.

Cleavage reactions were prepared with final RNP concentrations of 100 nM and a final target concentration of 100 nM. Reactions were carried out at 37° C. and initiated by the addition of the 7.37 target DNA. Aliquots were taken at 5, 10, 30, 60, and 120 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software. The resulting data were plotted and analyzed using Prism. We assumed that CasX acts essentially as a single-turnover enzyme under the assayed conditions, as indicated by the observation that sub-stoichiometric amounts of enzyme fail to cleave a greater-than-stoichiometric amount of target even under extended time-scales and instead approach a plateau that scales with the amount of enzyme present. Thus, the fraction of target cleaved over long time-scales by an equimolar amount of RNP is indicative of what fraction of the RNP is properly formed and active for cleavage. The cleavage traces were fit with a biphasic rate model, as the cleavage reaction clearly deviates from monophasic under this concentration regime, and the plateau was determined for each of three independent replicates. The mean and standard deviation were calculated to determine the active fraction (Table 14). The graphs are shown in FIG. 37.

Figure 38:
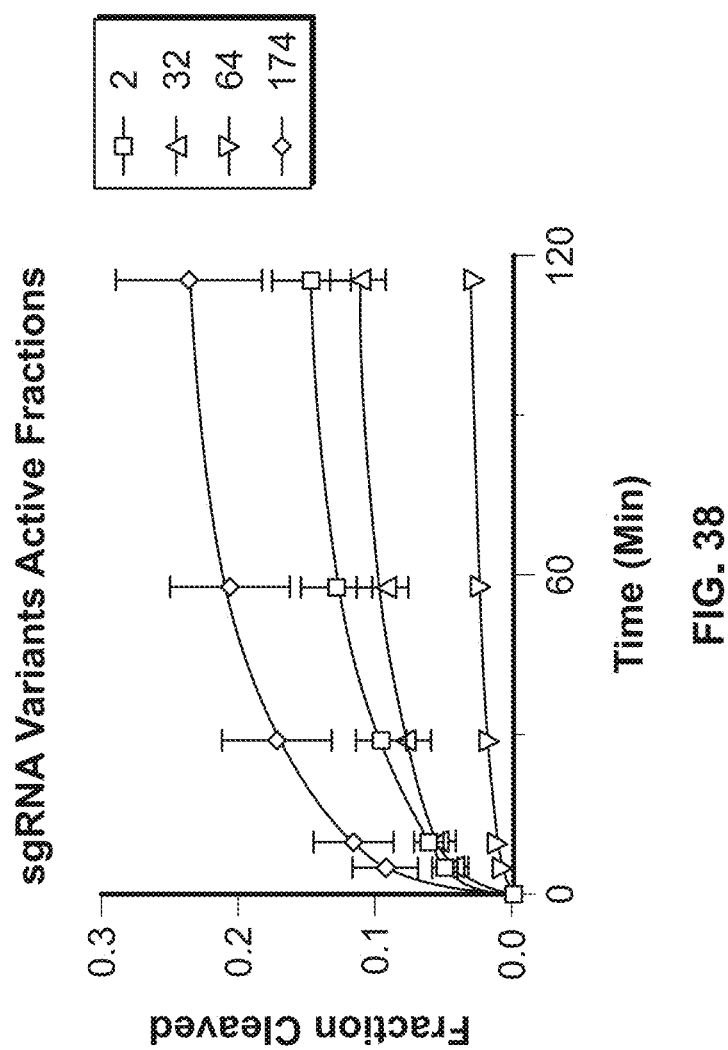
FIG. 38 is a graph of the results of an assay for quantification of active fractions of RNP formed by CasX2 and reference guide 2 the modified sgRNA guides 32, 64, and 174, as described in Example 19. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to reference gRNAs SEQ ID NO: 5, respectively, and the identifying number of modified sgRNAs are indicated in Table 2.

Apparent active (competent) fractions were determined for RNPs formed for CasX2+ guide 174+7.37 spacer, CasX119+ guide 174+7.37 spacer, and CasX459+ guide 174+7.37 spacer. The determined active fractions are shown in Table 14. Both CasX variants had higher active fractions than the wild-type CasX2, indicating that the engineered CasX variants form significantly more active and stable RNP with the identical guide under tested conditions compared to wild-type CasX. This may be due to an increased affinity for the sgRNA, increased stability or solubility in the presence of sgRNA, or greater stability of a cleavage-competent conformation of the engineered CasX:sgRNA complex. An increase in solubility of the RNP was indicated by a notable decrease in the observed precipitate formed when CasX457 was added to the sgRNA compared to CasX2. Cleavage-competent fractions were also determined for CasX2.2.7.37, CasX2.32.7.37, CasX2.64.7.37, and CasX2.174.7.37 to be 16±3%, 13±3%, 5±2%, and 22±5%, as shown in FIG. 38.

The data indicate that both CasX variants and sgRNA variants are able to form a higher degree of active RNP with guide RNA compare to wild-type CasX and wild-type sgRNA.

2. In Vitro Cleavage Assays—Determining $k_{cleave}$ for CasX Variants Compared to Wild-Type Reference CasX The apparent cleavage rates of CasX variants 119 and 457 compared to wild-type reference CasX were determined using an in vitro fluorescent assay for cleavage of the target 7.37.

Figure 39:
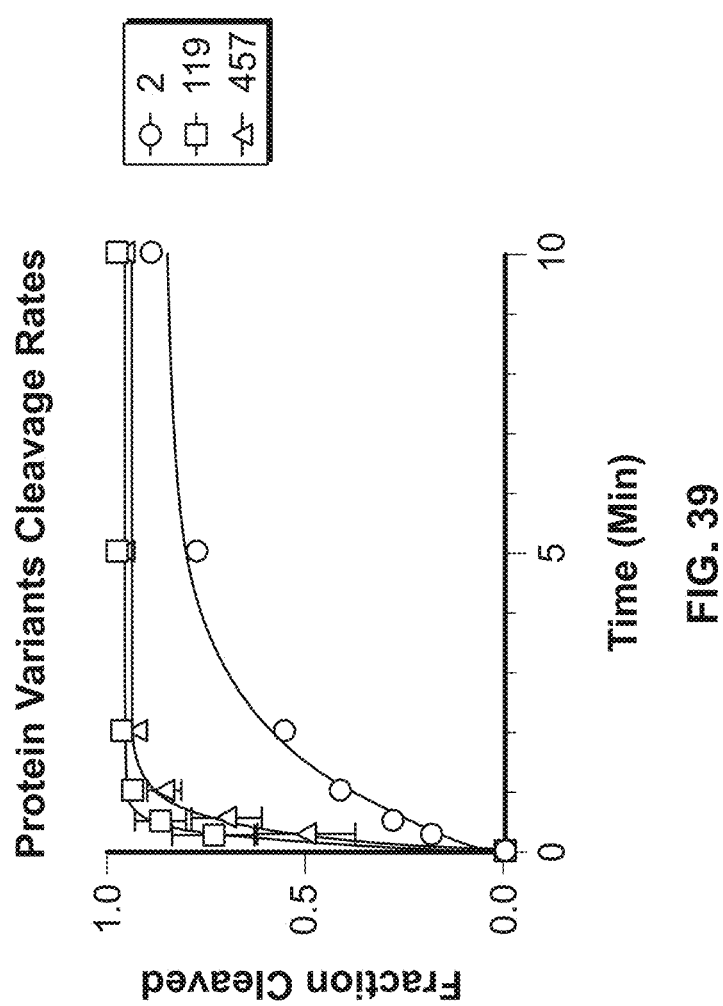
FIG. 39 is a graph of the results of an assay for quantification of cleavage rates of RNP formed by sgRNA174 and the CasX variants 119 and 457, as described in Example 19. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.

CasX RNPs were reconstituted with the indicated CasX (see FIG. 39) at a final concentration of 1 µM with 1.5-fold excess of the indicated guide in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. Cleavage reactions were set up with a final RNP concentration of 200 nM and a final target concentration of 10 nM. Reactions were carried out at 37° C. and initiated by the addition of the target DNA. Aliquots were taken at 0.25, 0.5, 1, 2, 5, and 10 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software. The resulting data were plotted and analyzed using Prism, and the apparent first-order rate constant of non-target strand cleavage ($k_{cleave}$) was determined for each CasX:sgRNA combination replicate individually. The mean and standard deviation of three replicates with independent fits are presented in Table 14, and the cleavage traces are shown in FIG. 38.

Apparent cleavage rate constants were determined for wild-type CasX2, and CasX variants 119 and 457 with guide 174 and spacer 7.37 utilized in each assay. Under the assayed conditions, the $k_{cleave}$ of CasX2, CasX119, and CasX457 were 0.51±0.01 $min^{-1}$, 6.29±2.11 $min^{-1}$, and 3.01±0.90 $min^{-1}$ (mean±SD), respectively (see Table 14 and FIG. 39). Both CasX variants had improved cleavage rates relative to the wild-type CasX2, though notably CasX119 has a higher cleavage rate under tested conditions than CasX457. As demonstrated by the active fraction determination, however, CasX457 more efficiently forms stable and active RNP complexes, allowing different variants to be used depending on whether the rate of cutting or the amount of active holoenzyme is more important for the desired outcome.

The data indicate that the CasX variants have a higher level of activity, with $K_{cleave}$ rates approximately 5 to 10-fold higher compared to wild-type CasX2.

3. In Vitro Cleavage Assays: Comparison of Guide Variants to Wild-Type Guides

Cleavage assays were also performed with wild-type reference CasX2 and reference guide 2 compared to guide variants 32, 64, and 174 to determine whether the variants improved cleavage. The experiments were performed as described above. As many of the resulting RNPs did not approach full cleavage of the target in the time tested, we determined initial reaction velocities (Vo) rather than first-order rate constants. The first two timepoints (15 and 30 seconds) were fit with a line for each CasX:sgRNA combination and replicate. The mean and standard deviation of the slope for three replicates were determined.

Figure 40:
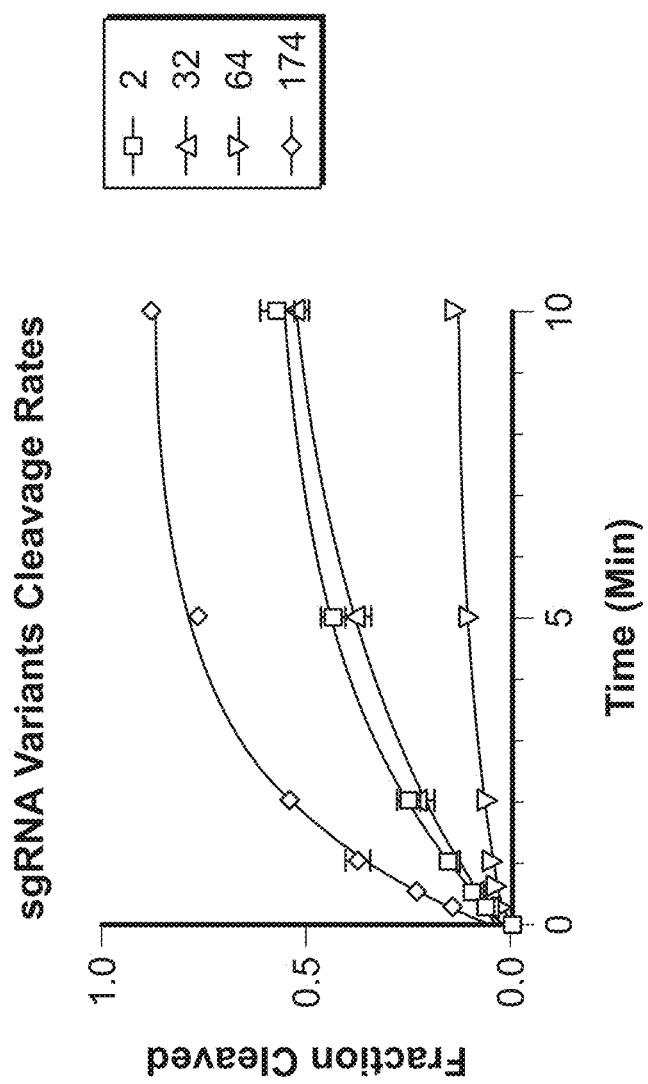
FIG. 40 is a graph of the results of an assay for quantification of cleavage rates of RNP formed by CasX2 and the sgRNA guide variants 2, 32, 64 and 174, as described in Example 19. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.
Figure 41:
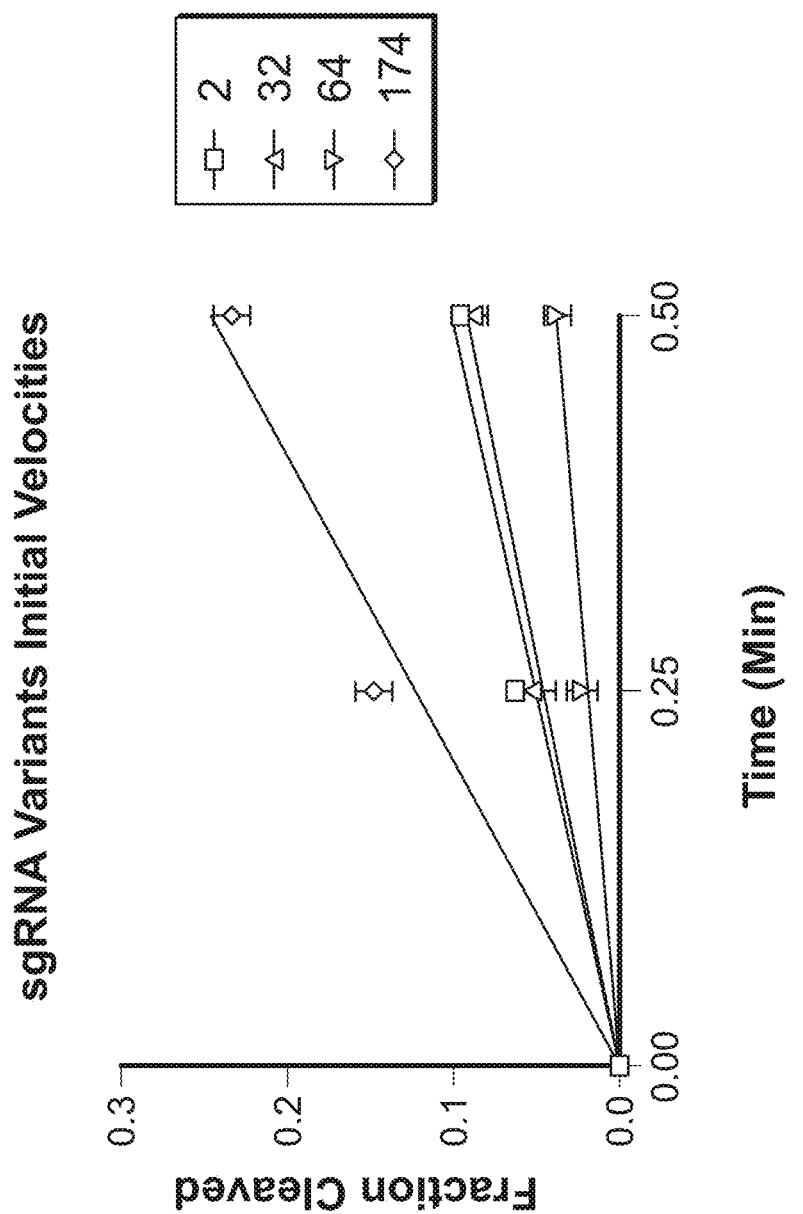
FIG. 41 is a graph of the results of an assay for quantification of initial velocities of RNP formed by CasX2 and the sgRNA guide variants 2, 32, 64 and 174, as described in Example 19. The first two time-points of the previous cleavage experiment were fit with a linear model to determine the initial cleavage velocity.

Under the assayed conditions, the Vo for CasX2 with guides 2, 32, 64, and 174 were 20.4±1.4 nM/min, 18.4±2.4 nM/min, 7.8±1.8 nM/min, and 49.3±1.4 nM/min (see Table 14 and FIG. 40). Guide 174 showed substantial improvement in the cleavage rate of the resulting RNP (~2.5-fold relative to 2, see FIG. 41), while guides 32 and 64 performed similar to or worse than guide 2. Notably, guide 64 supports a cleavage rate lower than that of guide 2 but performs much better in vivo (data not shown). Some of the sequence alterations to generate guide 64 likely improve in vivo transcription at the cost of a nucleotide involved in triplex formation. Improved expression of guide 64 likely explains its improved activity in vivo, while its reduced stability may lead to improper folding in vitro.

TABLE 14

Results of cleavage and RNP formation assays

| RNP Construct | $k_{cleave}$* | Initial velocity* | Competent fraction |
|---|---|---|---|
| 2.2.7.37 | | 20.4 ± 1.4 nM/min | 16 ± 3% |
| 2.32.7.37 | | 18.4 ± 2.4 nM/min | 13 ± 3% |
| 2.64.7.37 | | 7.8 ± 1.8 nM/min | 5 ± 2% |
| 2.174.7.37 | 0.51 ± 0.01 min$^{-1}$ | 49.3 ± 1.4 nM/min | 22 ± 5% |
| 119.174.7.37 | 6.29 ± 2.11 min$^{-1}$ | | 35 ± 6% |
| 457.174.7.37 | 3.01 ± 0.90 min$^{-1}$ | | 53 ± 7% |

*Mean and standard deviation

Example 20: Generation and Assay of AAV Vectors Delivering CasX Constructs Targeting SOD1

This example describes a typical protocol followed to produce and characterize AAV2 vectors packaging CasX molecules and guides.

Figure 42:
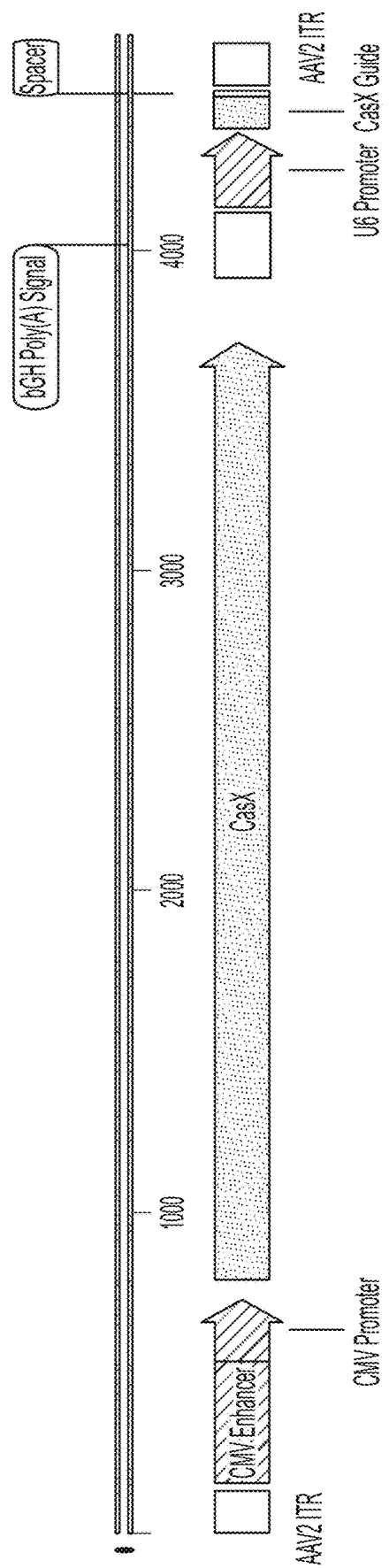
FIG. 42 is a schematic showing an example of CasX protein and scaffold DNA sequence for packaging in adeno-associated virus (AAV), as described in Example 20. The DNA segment between the AAV inverted terminal repeats (ITRs), comprised of a CasX-encoding DNA and its promoter, and scaffold-encoding DNA and its promoter gets packaged within an AAV capsid during AAV production.

Materials and Methods:

For AAV production, the tri-plasmid transfection method was used, using three essential plasmids—pTransgene carrying the gene of interest to be packaged in AAV, pRC, and pHelper. DNA encoding CasX and guide RNA were cloned into an AAV transgene cassette, between the ITRs (FIG. 42) to generate the pTransgene plasmid. The constructed transgene plasmid was verified via full-length plasmid sequencing (see Table 15), restriction digestion, and functional tests including in vitro transfection of mammalian cells. Additional plasmids required for AAV production (pRC plasmid and pHelper plasmid) were purchased from commercial suppliers (Aldevron, Takara).

For AAV production, HEK293/T cells were cultured in FB medium in a 37° C. incubator with 5% CO2. 10-20 15 cm dishes of HEK293T cells were used in a single batch of viral production. For a single 15 cm dish, 15 ug of each plasmid was first mixed together in 4 ml of FB medium, and complexed with 145 ug polyethyleneimine (PEI) i.e., at 3 ug PEI/ug of DNA, for 10 mins at room temperature. The ratio of the three plasmids used may be varied to further optimize virus production as needed.

The PEI-DNA complex was then slowly dripped onto the 15 cm plate of HEK293T cells, and the plate of transfected cells moved back into the incubator. The next day, the medium was changed to FB with 2% FBS (instead of 10% FBS). At 3 days post-transfection, the media from the cells may be collected to increase virus yields. At 5-6 days post-transfection medium and cells were collected. The timing of harvest may be further varied to optimize virus yield.

The cells were pelleted by centrifugation, and the medium collected from the top. Cells were lysed in a buffer with high salt content and high-salt-active nuclease for 1h at 37° C. The cells may also be lysed using additional methods, such as sequential freeze-thaw, or chemical lysis by detergent.

The medium collected at harvest, and any medium collected at earlier time points, were treated with a 1:5 dilution of a solution containing 40% PEG8000 and 2.5M NaCl, and incubated on ice for 2h, in order to precipitate AAV. The incubation may also be carried out overnight at 4° C.

The AAV precipitate from the medium was pelleted by centrifugation, resuspended in high salt content buffer with high-salt-active nuclease and combined with the lysed cell pellet. The combined cell lysate was then clarified by centrifugation and filtration through a 0.45 um filter, and purified on an AAV Poros affinity resin column (Thermofisher Scientific). The virus was eluted from the column into a neutralizing solution. At this stage, the virus may be taken through additional rounds of purification to increase the quality of the virus preparation.

The eluted virus was then titered via qPCR to quantify the virus yield. For titering, a sample of virus was first digested with DNAse to remove any non-packaged viral DNA, the DNAse deactivated, and then viral capsids disrupted with Proteinase K to expose the packaged viral genomes for titering.

Figure 43:
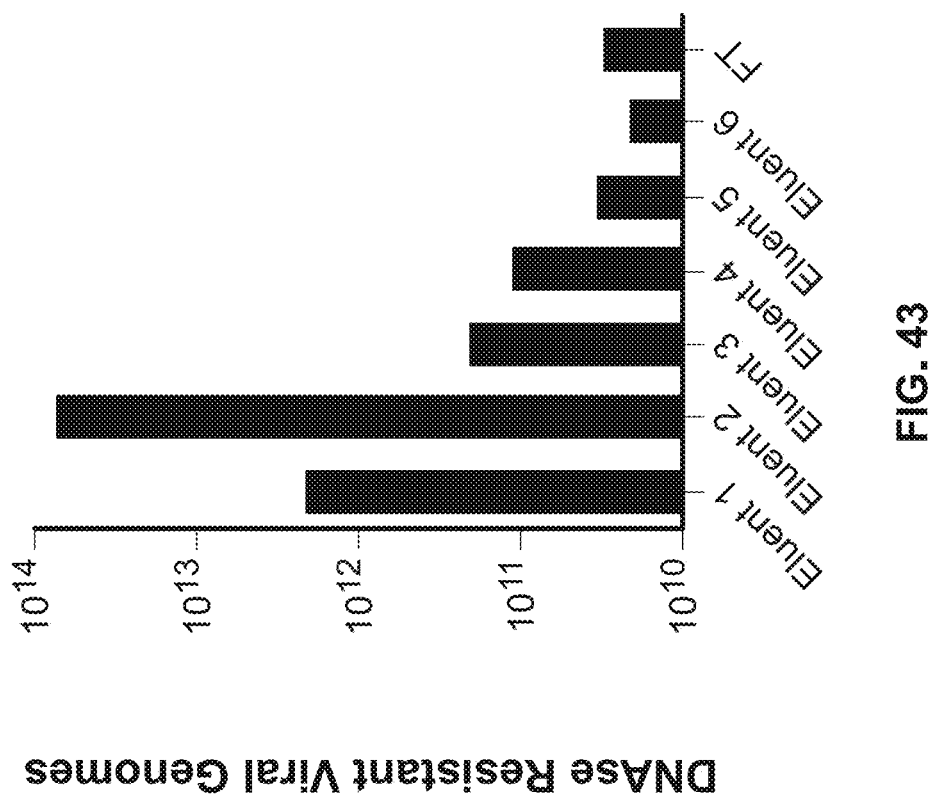
FIG. 43 is a graph showing representative results of AAV titering by qPCR, as described in Example 20. During AAV purification, flow through (FT) and consecutive eluent fractions (1-6) are collected and titered by qPCR. Most virus, ~1e14 viral genomes in this example, is found in the second elution fraction.

Results:

Representative titers for AAV packaging DNA encoding a CasX 119 molecule and rRNA guide 64 (119.64) with a spacer having the sequence ATGTTCATGAGTTTG-GAGAT; SEQ ID NO: 239 is shown in FIG. 43. Typically, ~1e13 viral genomes were obtained from one batch of virus production as described here.

This example demonstrates that i) CasX and a gNA can be cloned into an AAV transgene construct, and ii) CasX and guide can be packaged in an AAV vector and produced at sufficiently high titers.

TABLE 15

Sequence of pStx17 Construct

| Construct | DNA sequence |
|---|---|
| pStX17 | SEQ ID NO: 3569 |

Example 21: Administration of AAV Vectors Encoding a CasX System In Vitro and Evidence of SOD1 Gene Editing Materials and Methods:

SOD1-GFP reporter cells were seeded at 30 k cells/well in a 96 well plate in 100 µl of FB medium. Confluence of cells was checked the next day, and cells were transduced at 80% confluence with AAV vectors (packaging construct 119.64 targeting SOD1, and SauCas9 targeting SOD1) at a range of doses or multiplicity of infection (MOI), for example from 1e7 to 1 viral genomes per cell. In a separate experiment, neural progenitor cells from the G93A mouse model of ALS (G93A NPCs) were similarly transduced. NPCs are cultured in NPC medium (DMEMF12 with Glutamax, supplemented with 10 mM Hepes (100× Thermofisher #15630080), non-essential amino acids (100×

Thermofisher #11140050), penicillin-streptomycin (100×-Pen-Strep; GIBCO #15140-122), 2-mercaptoethanol 1000× (Thermofisher #21985023), B27 without vitamin-A (50×, Thermofisher), N2 (100×, Thermofisher), 20 ng/ml bFGF (Biolegend Cat no #579606), and 20 ng/ml EGF (Thermofisher #PHG0311)) at 37° C. and 5% CO2. The AAV doses were calculated based on viral titers determined by qPCR. Fresh FB medium or NPC medium may be replenished the next day, or as needed. Starting at 5 days post-transduction, and weekly thereafter, a portion of the cells were analyzed via flow cytometry or T7E1 assay.

Figure 44:
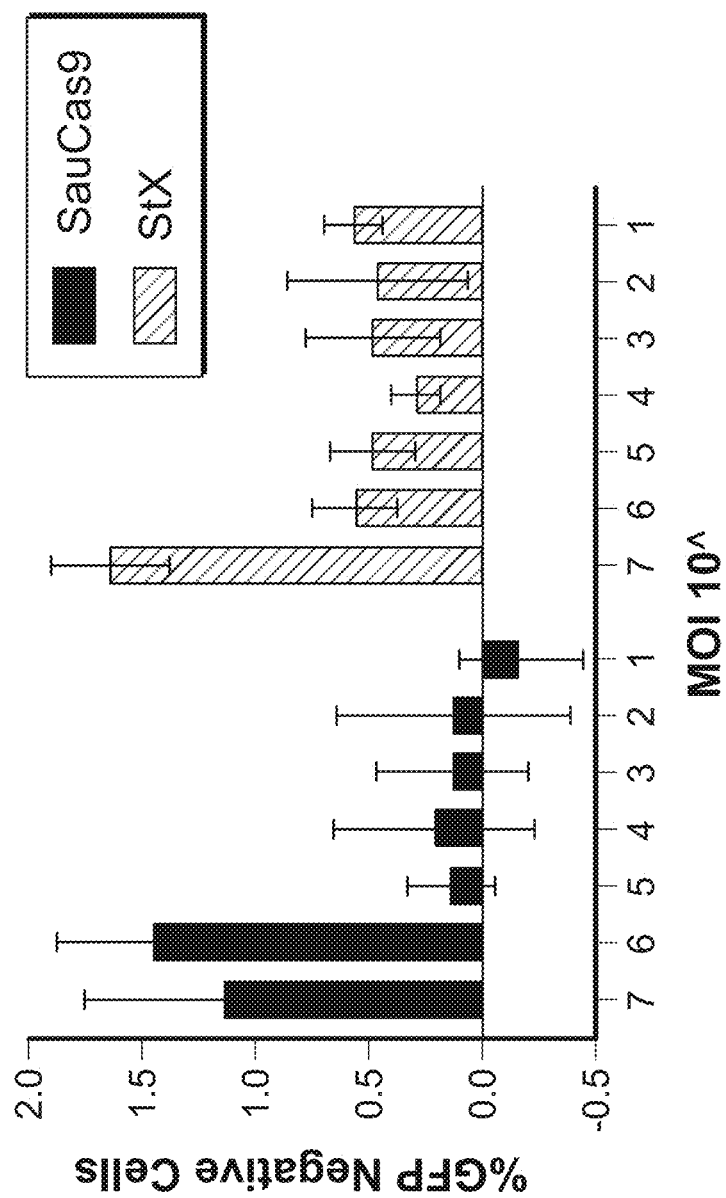
FIG. 44 shows the results of an AAV-mediated gene editing experiment in the SOD1-GFP reporter cell line, as described in Example 21. CasX constructs (CasX 119 and guide 64 with SOD1 targeting spacer 2, ATGTTCATGAGTTTGGAGAT; SEQ ID NO: 239) and SauCas9 with SOD1 targeting spacer were packaged in AAV vectors and used to transduce SOD1-GFP reporter cells at a range of different multiplicity of infection (MOIs, no. of viral genomes/cell). Twelve days later, cells were assayed for GFP disruption via FACS. In this example, CasX and SauCas9 shows equivalent levels of editing, where 1-2% of the cells show GFP disruption at the highest MOIs, 1e7 or 1e6.
Figure 45:
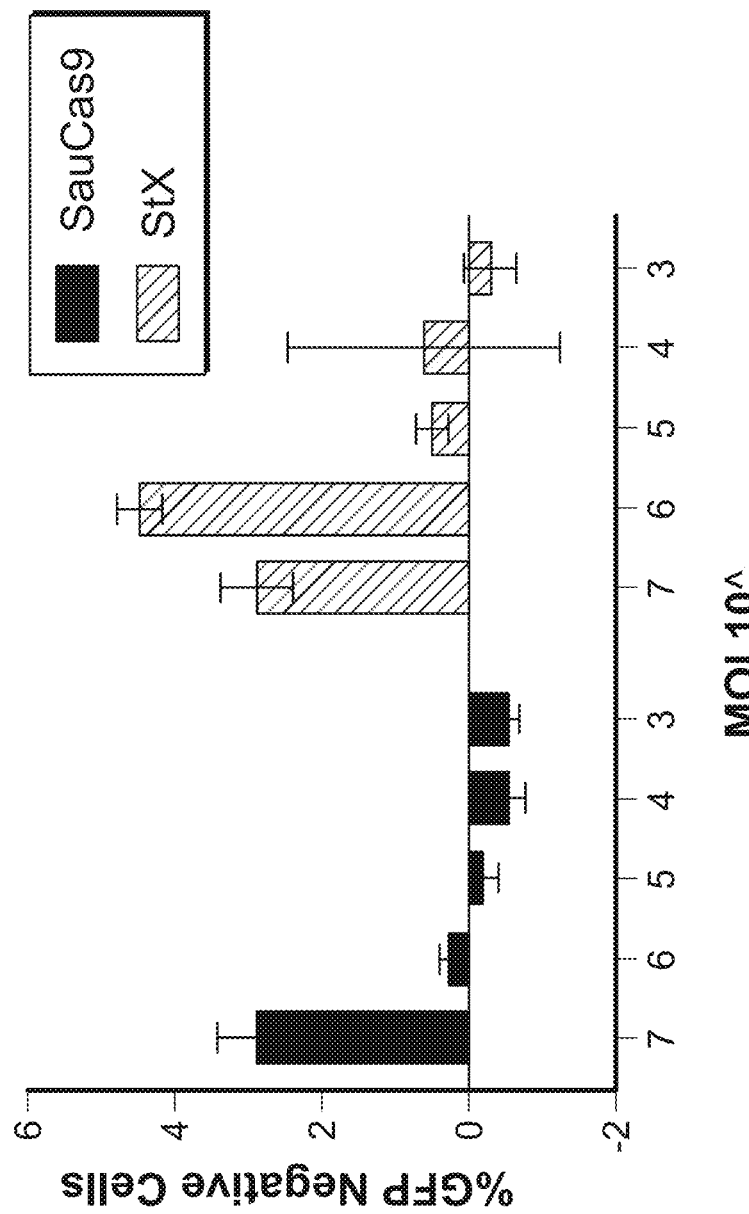
FIG. 45 shows the results of a second AAV-mediated gene editing experiment in the SOD1-GFP reporter cell line, as described in Example 21. CasX constructs 119.64 with SOD1 targeting spacer (2, ATGTTCATGAGTTTGGAGAT; SEQ ID NO: 239) and SauCas9 with SOD1 targeting spacer were packaged in AAV vectors and used to transduce SOD1-GFP reporter cells at a range of different multiplicity of infection (MOIs, no. of viral genomes/cell). Twelve days later, cells were assayed for GFP disruption via FACS. In this example, CasX and SauCas9 shows equivalent levels of editing at the highest MOI, where ~2-4% of the cells show GFP disruption.
Figure 46:
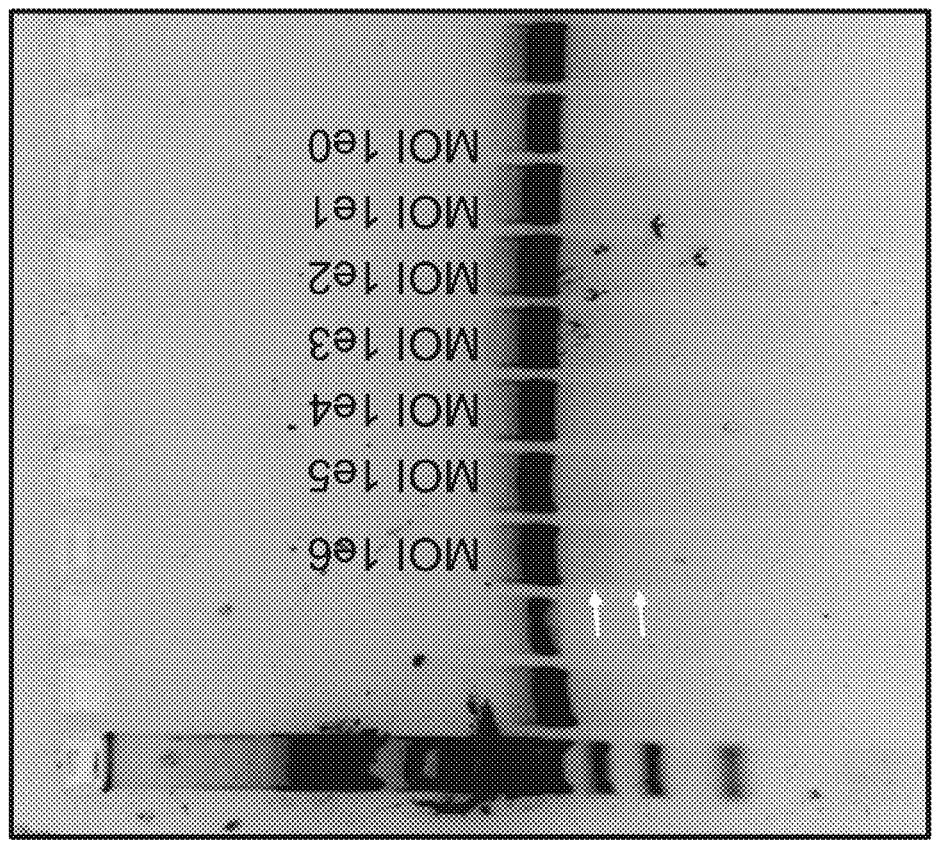
FIG. 46 shows the results of an AAV-mediated gene editing experiment in neural progenitor cells (NPCs) from the G93A mouse model of ALS, as described in Example 21. CasX constructs (CasX 119 and guide 64 with SOD1 targeting spacer 2, ATGTTCATGAGTTTGGAGAT; SEQ ID NO: 239) was packaged in an AAV vector and used to transduce G93A NPCs at a range of different multiplicity of infection (MOIs, no. of viral genomes/cell). Twelve days later, cells were assayed for gene editing via T7E1 assay. Agarose gel image from the T7E1 assay shown here demonstrates successful editing of the SOD1 locus. Double arrows show the two DNA bands as a result of successful editing in cells.

Results:

A representative example of SOD1 editing, as demonstrated by percentage of GFP negative cells, at 12 days post-transduction is shown in FIG. 44 and FIG. 45. FIG. 46 shows CasX delivered via AAV, with evidence of editing of G93A NPCs.

This example demonstrates that CasX constructs targeting SOD1 may be delivered to mammalian cells via AAV, and result in successful editing of the SOD1 locus.

Example 22: In Vitro Transcription for the Generation of Guides and Spacers

For the generation of RNA single guides and spacers, templates for in vitro transcription were generated by performing PCR with Q5 polymerase (NEB M0491) according to the recommended protocol, with template oligos for each backbone and amplification primers with the T7 promoter and the spacer sequence. The DNA primer sequences for the T7 promoter, guide and spacer for guides and spacers are presented in Table 16, below. The template oligos, labeled "backbone fwd" and "backbone rev" for each scaffold, were included at a final concentration of 20 nM each, and the amplification primers (T7 promoter and the unique spacer primer) were included at a final concentration of 1 uM each. The sg2, sg32, sg64, and sg174 guides correspond to SEQ ID NOS: 5, 2104, 2106, and 2238, respectively, with the exception that sg2, sg32, and sg64 were modified with additional 5' G to increase transcription efficiency (compare sequences in Table 16 to Table 2). The 7.37 spacer targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM MgCl$_2$, 0.01% Triton™ X-100, 2 mM spermidine, 20 mM DTT, 5 mM NTPs, 0.5 μM template, and 100 μg/mL T7 RNA polymerase. Reactions were incubated at 37° C. overnight. 20 units of DNase I (Promega #M6101)) were added per 1 mL of transcription volume and incubated for one hour. RNA products were purified via denaturing PAGE, ethanol precipitated, and resuspended in 1× phosphate buffered saline. To fold the sgRNAs, samples were heated to 70° C. for 5 min and then cooled to room temperature. The reactions were supplemented to 1 mM final MgCl$_2$ concentration, heated to 50° C. for 5 min and then cooled to room temperature. Final RNA guide products were stored at −80° C.

TABLE 16

Sequences

| Primer | Primer Sequence (SEQ ID NO) | SEQ ID NO | RNA product |
|---|---|---|---|
| T7 promoter primer | 3550 | NA | Used for all |
| sg2 backbone fwd | 3551 | 3563 | GGUACUGGCGCUUUUAUCUCAUUACUUUGAG |
| sg2 backbone rev | 3552 | | AGCCAUCACCAGCGACUAUGUCGUAUGGGUA |
| sg2.7.37 spacer primer | 3553 | | AAGCGCUUAUUUAUCGGAGAGAAAUCCGAUA AAUAAGAAGCAUCAAAGGGCCGAGAUGUCUC GCUCCG |
| sg32 backbone fwd | 3554 | 3564 | GGUACUGGCCCUUUUAUCUCAUUACUUUGAG |
| sg32 backbone rev | 3555 | | AGCCAUCACCAGCGACUAUGUCGUAUGGGUA |
| sg32.7.37 spacer primer | 3556 | | AAGCGCCCUCUUCGGAGGGAAGCAUCAAAGG GCCGAGAUGUCUCG |
| sg64 backbone fwd | 3557 | 3565 | GGUACUGGCGCCUUUAUCUCAUUACUUUGAG |
| sg64 backbone rev | 3558 | | AGCCAUCACCAGCGACUAUGUCGUAUGGGUA |
| 5g64.7.37 spacer primer | 3559 | | AAGCGCUUACGGACUUCGGUCCGUAAGAAGC AUCAAAGGGCCGAGAUGUCUCGCUCCG |
| sg174 backbone fwd | 3560 | 3566 | ACUGGCGCUUUUAUCUgAUUACUUUGAGAGC |
| sg174 backbone rev | 3561 | | CAUCACCAGCGACUAUGUCGUAgUGGGUAAA |
| sg174.7.37 spacer primer | 3562 | | GCUCCCUCUUCGGAGGGAGCAUCAAAGGGCC GAGAUGUCUCGCUCCG |

Example 23: Editing of Gene Targets PCSK9, PMP22, TRAC, SOD1, B2M and HTT

The purpose of this study was to evaluate the ability of the CasX variant 119 and gNA variant 174 to edit nucleic acid sequences in six gene targets.

Materials and Methods

Spacers for all targets except B2M and SOD1 were designed in an unbiased manner based on PAM requirements (TTC or CTC) to target a desired locus of interest. Spacers targeting B2M and SOD1 had been previously identified within targeted exons via lentiviral spacer screens carried out for these genes. Designed spacers for the other targets were ordered from Integrated DNA Technologies (IDT) as single-stranded DNA (ssDNA) oligo pairs. ssDNA spacer pairs were annealed together and cloned via Golden Gate cloning into a base mammalian-expression plasmid construct that contains the following components: codon optimized Cas X 119 protein+NLS under an EF1A promoter, guide scaffold 174 under a U6 promoter, carbenicillin and puromycin resistance genes. Assembled products were transformed into chemically-competent E. coli, plated on Lb-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) following the manufacturer's protocol. The resulting plasmids were sequenced through the guide scaffold region via Sanger sequencing (Quintara Biosciences) to ensure correct ligation.

HEK 293T cells were grown in Dulbecco's Modified Eagle Medium (DMEM; Corning Cellgro, #10-013-CV) supplemented with 10% fetal bovine serum (FBS; Seradigm, #1500-500), 100 Units/ml penicillin and 100 mg/ml streptomycin (100x-Pen-Strep; GIBCO #15140-122), sodium pyruvate (100x, Thermofisher #11360070), non-essential amino acids (100x Thermofisher #11140050), HEPES buffer (100x Thermofisher #15630080), and 2-mercaptoethanol (1000x Thermofisher #21985023). Cells were passed every 3-5 days using TrypIE and maintained in an incubator at 37° C. and 5% CO2.

On day 0, HEK293T cells were seeded in 96-well, flat-bottom plates at 30 k cells/well. On day 1, cells were transfected with 100 ng plasmid DNA using Lipofectamine™ 3000 according to the manufacturer's protocol. On day 2, cells were switched to FB medium containing puromycin. On day 3, this media was replaced with fresh FB medium containing puromycin. The protocol after this point diverged depending on the gene of interest. Day 4 for PCSK9, PMP22, and TRAC: cells were verified to have completed selection and switched to FB medium without puromycin. Day 4 for B2M, SOD1, and HTT: cells were verified to have completed selection and passed 1:3 using TrypIE into new plates containing FB medium without puromycin. Day 7 for PCSK9, PMP22, and TRAC: cells were lifted from the plate, washed in dPBS, counted, and resuspended in Quick Extract (Lucigen, QE09050) at 10,000 cells/μl. Genomic DNA was extracted according to the manufacturer's protocol and stored at −20° C. Day 7 for B2M, SOD1, and HTT: cells were lifted from the plate, washed in dPBS, and genomic DNA was extracted with the Quick-DNA Miniprep Plus Kit (Zymo, D4068) according to the manufacturer's protocol and stored at −20° C.

NGS Analysis: Editing in cells from each experimental sample was assayed using next generation sequencing (NGS) analysis. All PCRs were carried out using the KAPA HiFi HotStart ReadyMix PCR Kit (KR0370). The template for genomic DNA sample PCR was 5 μl of genomic DNA in QE at 10 k cells/μL for PCSK9, PMP22, and TRAC. The template for genomic DNA sample PCR was 400 ng of genomic DNA in water for B2M, SOD1, and HTT. Primers were designed specific to the target genomic location of interest to form a target amplicon. These primers contain additional sequence at the 5' ends to introduce Illumina read 1 and 2 sequences. Further, they contain a 7 nt randomer sequence that functions as a unique molecular identifier (UMI). Quality and quantification of the amplicon was assessed using a Fragment Analyzer DNA analyzer kit (Agilent, dsDNA 35-1500 bp). Amplicons were sequenced on the Illumina Miseq™ according to the manufacturer's instructions. Resultant sequencing reads were aligned to a reference sequence and analyzed for indels. Samples with editing that did not align to the estimated cut location or with unexpected alleles in the spacer region were discarded.

Results

Figure 47:
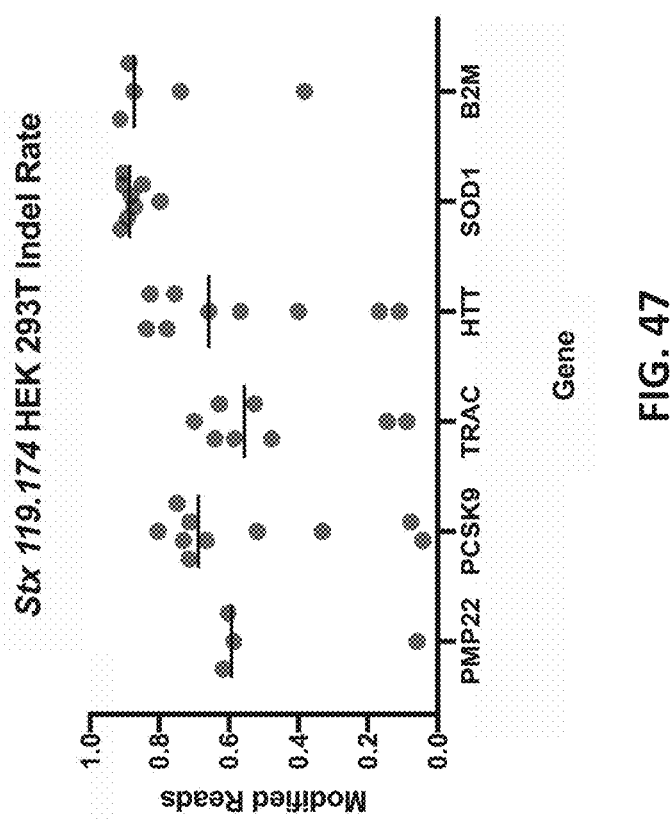
FIG. 47 shows the results of an editing assay of 6 target genes in HEK293T cells, as described in Example 23. Each dot represents results using an individual spacer.
Figure 48:
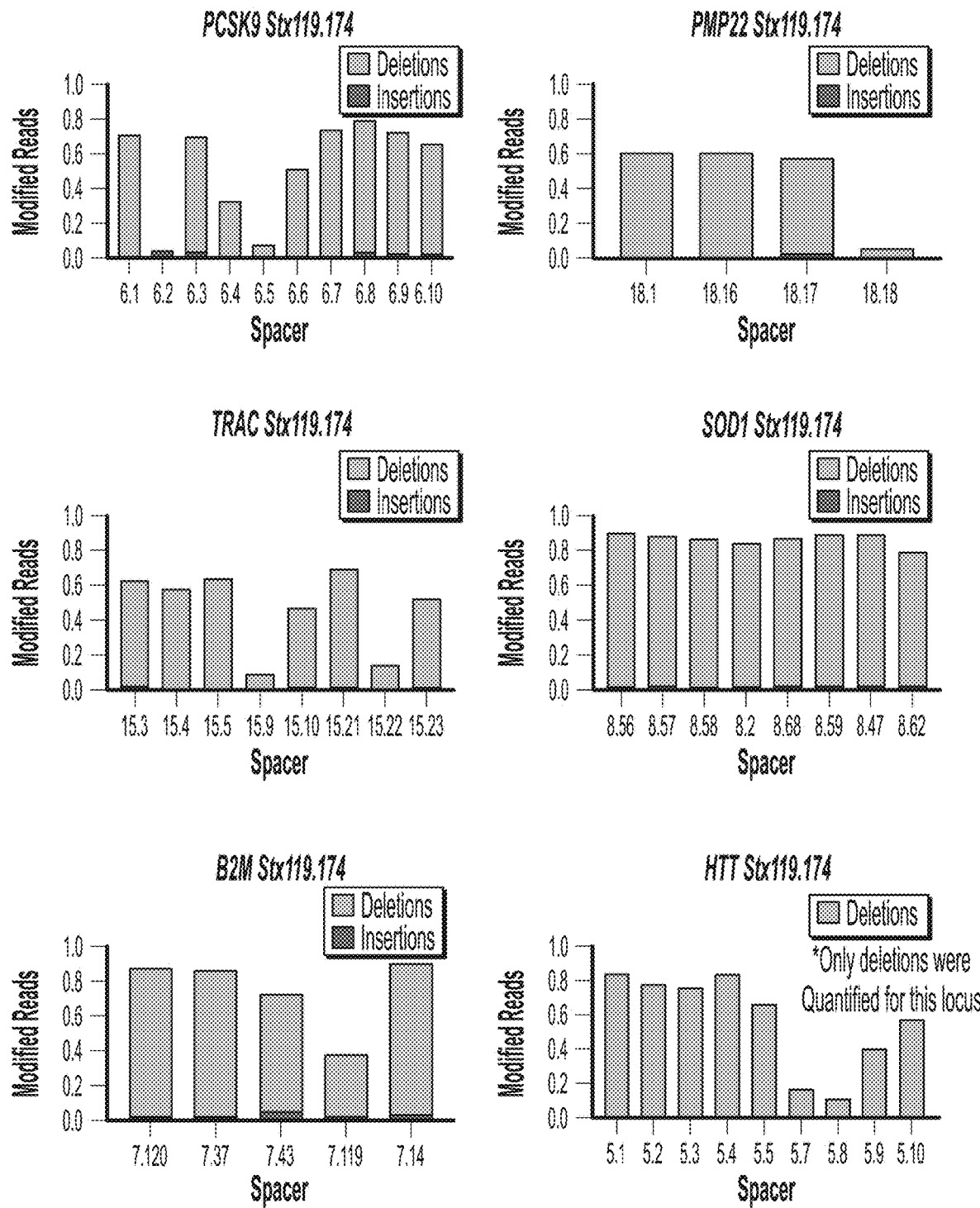
FIG. 48 shows the results of an editing assay of 6 target genes in HEK293T cells, with individual bars representing the results obtained with individual spacers, as described in Example 23.
Figure 49:
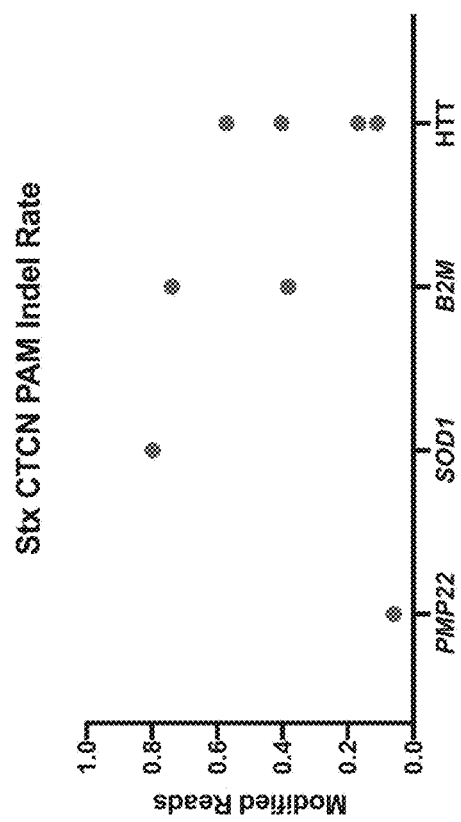
FIG. 49 shows the results of an editing assay of 4 target genes in HEK293T cells, as described in Example 23. Each dot represents results using an individual spacer utilizing a CTC (CTCN) PAM.

In order to validate the editing effected by the CasX:gNA 119.174 at a variety of genetic loci, a clonal plasmid transfection experiment was performed in HEK 293T cells. Multiple spacers (Table 17) were designed and cloned into an expression plasmid encoding the CasX 119 nuclease and guide 174 scaffold. HEK 293T cells were transfected with plasmid DNA, selected with puromycin, and harvested for genomic DNA six days post-transfection. Genomic DNA was analyzed via next generation sequencing (NGS) and aligned to a reference DNA sequence for analysis of insertions or deletions (indels). CasX:gNA 119.174 was able to efficiently generate indels across the 6 target genes, as shown in FIGS. 47 and 48. Indel rates varied between spacers, but median editing rates were consistently at 60% or higher, and in some cases, indel rates as high as 91% were observed. Additionally, spacers with non-canonical CTC PAMs were demonstrated to be able to generate indels with all tested target genes (FIG. 49).

The results demonstrate that the CasX variant 119 and gNA variant 174 can consistently and efficiently generate indels at a wide variety of genetic loci in human cells. The unbiased selection of many of the spacers used in the assays shows the overall effectiveness of the 119.174 RNP molecules to edit genetic loci, while the ability to target to spacers with both a TTC and a CTC PAM demonstrates its increased versatility compared to reference CasX that edit only with the TTC PAM.

TABLE 17

Spacer sequences targeting each genetic locus.

| Gene | Spacer | PAM | Spacer Sequence | SEQ ID NO: |
|---|---|---|---|---|
| PCSK9 | 6.1 | TTC | GAGGAGGACGGCCTGGCCGA | 3570 |
| PCSK9 | 6.2 | TIC | ACCGCTGCGCCAAGGTGCGG | 3571 |
| PCSK9 | 6.4 | TTC | GCCAGGCCGTCCTCCTCGGA | 3572 |
| PCSK9 | 6.5 | TTC | GTGCTCGGGTGCTTCGGCCA | 3573 |
| PCSK9 | 6.3 | TTC | ATGGCCTTCTTCCTGGCTTC | 3574 |
| PCSK9 | 6.6 | TTC | GCACCACCACGTAGGTGCCA | 3575 |
| PCSK9 | 6.7 | TTC | TCCTGGCTTCCTGGTGAAGA | 3576 |
| PCSK9 | 6.8 | TTC | TGGCTTCCTGGTGAAGATGA | 3577 |
| PCSK9 | 6.9 | TTC | CCAGGAAGCCAGGAAGAAGG | 3578 |

TABLE 17-continued

Spacer sequences targeting each genetic locus.

| Gene | Spacer | PAM | Spacer Sequence | SEQ ID NO: |
|---|---|---|---|---|
| PCSK9 | 6.10 | TTC | TCCTTGCATGGGGCCAGGAT | 3579 |
| PMP22 | 18.16 | TIC | GGCGGCAAGTTCTGCTCAGC | 3580 |
| PMP22 | 18.17 | TTC | TCTCCACGATCGTCAGCGTG | 3581 |
| PMP22 | 18.18 | CTC | ACGATCGTCAGCGTGAGTGC | 3582 |
| PMP22 | 18.1 | TTC | CTCTAGCAATGGATCGTGGG | 3583 |
| TRAC | 15.3 | TIC | CAAACAAATGTGTCACAAAG | 3584 |
| TRAC | 15.4 | TTC | GATGTGTATATCACAGACAA | 3585 |
| TRAC | 15.5 | TTC | GGAATAATGCTGTTGTTGAA | 3586 |
| TRAC | 15.9 | TTC | AAATCCAGTGACAAGTCTGT | 3587 |
| TRAC | 15.10 | TTC | AGGCCACAGCACTGTTGCTC | 3588 |
| TRAC | 15,21 | TTC | AGAAGACACCTTCTTCCCCA | 3589 |
| TRAC | 15.22 | TTC | TCCCCAGCCCAGGTAAGGGC | 3590 |
| TRAC | 15.23 | TTC | CCAGCCCAGGTAAGGGCAGC | 3591 |
| HTT | 5.1 | TTC | AGTCCCTCAAGTCCTTCCAG | 3592 |
| HTT | 5,2 | TTC | AGCAGCAGCAGCAGCAGCAG | 3593 |
| HTT | 5.3 | TTC | TCAGCCGCCGCCGCAGGCAC | 3594 |
| HTT | 5.4 | TTC | AGGGTCGCCATGGCGGTCTC | 3595 |
| HTT | 5.5 | TTC | TCAGCTTTTCCAGGGTCGCC | 3596 |
| HTT | 5.7 | CTC | GCCGCAGCCGCCCCGCCGC | 3597 |
| HTT | 5.8 | CTC | GCCACAGCCGGGCCGGGTGG | 3598 |
| HTT | 5.9 | CTC | TCAGCCACAGCCGGGCCGGG | 3599 |
| HTT | 5.10 | CTC | CGGTCGGTGCAGCGGCTCCT | 3600 |
| SOD1 | 8.56 | TTC | CCACACCTTCACTGGTCCAT | 3601 |
| SOD1 | 8.57 | TTC | TAAAGGAAAGTAATGCACCA | 3602 |
| SOD1 | 8.58 | TTC | CTGGTCCATTACTTTCCTTT | 3603 |
| SOD1 | 8.2 | TTC | ATGTTCATGAGTTTGGAGAT | 239 |
| SOD1 | 8.68 | TTC | TGAGTTTGGAGATAATACAG | 3604 |
| SOD1 | 8.59 | TTC | ATAGACACATCGGCCACACC | 3605 |
| SOD1 | 8.47 | TTC | TTATTAGGCATGTTGGAGAC | 3606 |
| SOD1 | 8.62 | CTC | CAGGAGACCATTGCATCATT | 3607 |
| B2M | 7.120 | TTC | GGCCTGGAGGfTATCCAGCG | 3608 |
| B2M | 7.37 | TTC | GGCCGAGATGTCTCGCTCCG | 3609 |
| B2M | 7.43 | CTC | AGGCCAGAAAGAGAGAGTAG | 3610 |
| B2M | 7.119 | CTC | CGCTGGATAGCCTCCAGGCC | 3611 |
| B2M | 7.14 | TTC | TGAAGCTGACAGCATTCGGG | 3612 |

Example 24: Design and Evaluation of Improved CasX Variants by Deep Mutational Evolution The purpose of the experiments was to identify and engineer novel CasX protein variants with enhanced genome editing efficiency relative to wild-type CasX. To cleave DNA efficiently in living cells, the CasX protein must efficiently perform the following functions: i) form and stabilize the R-loop structure consisting of a targeting guide RNA annealed to a complementary genomic target site in a DNA:RNA hybrid; and ii) position an active nuclease domain to cleave both strands of the DNA at the target sequence. These two functions can each be enhanced by altering the biochemical or structural properties of the protein, specifically by introducing amino acid mutations or exchanging protein domains in an additive or combinatorial fashion.

To construct CasX protein variants with improved properties, an overall approach was chosen in which bacterial assays and hypothesis-driven approaches were first used to identify candidate mutations to enhance particular functions, after which increasingly stringent human genome editing assays were used in a stepwise manner to rationally combine cooperatively function-enhancing mutations in order to identify CasX variants with enhanced editing properties.

Materials and Methods:

Cloning and Media

Restriction enzymes, PCR reagents, and cloning strains of E. coli were obtained from New England Biolabs. All molecular biology and cloning procedures were performed according to the manufacturer's instructions. PCR was performed using Q5 polymerase unless otherwise specified. All bacterial culture growth was performed in 2XYT media (Teknova) unless otherwise specified. Standard plasmid cloning was performed in Turbo® E. coli unless otherwise specified. Standard final concentrations of the following antibiotics were used where indicated: carbenicillin: 100 µg/mL; kanamycin: 60 µg/mL; chloramphenicol: 25 µg/mL.

Molecular Biology of Protein Library Construction

Figure 50:
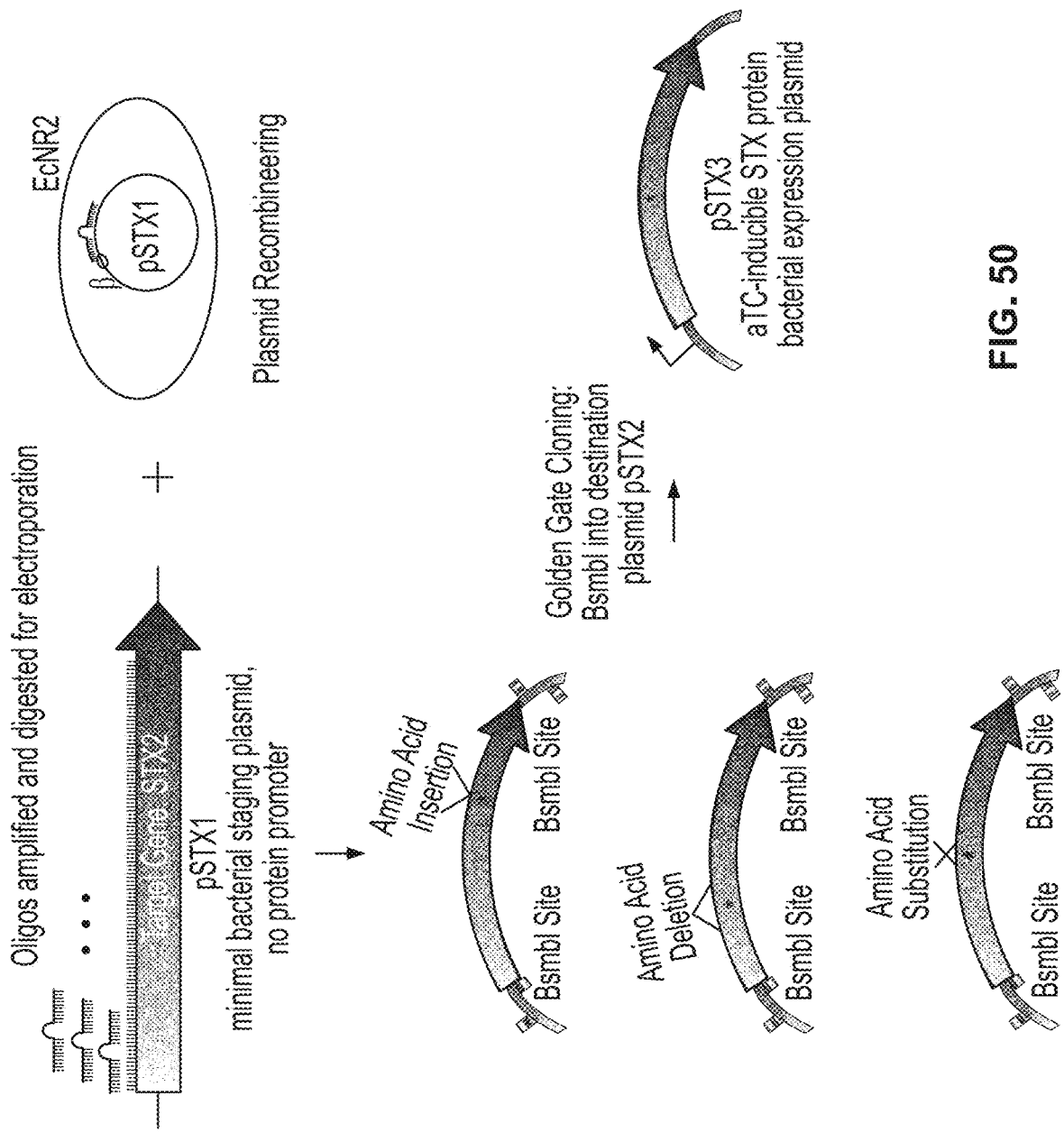
FIG. 50 is a schematic showing the steps of Deep Mutational Evolution used to create libraries of genes encoding CasX variants, as described in Example 24. The pSTX1 backbone is minimal, composed of only a high-copy number origin and KanR resistance gene, making it compatible with the recombineering *E. coli* strain EcNR2. pSTX2 is a BsmbI destination plasmid for aTc-inducible expression in *E. coli*.
Figure 51:
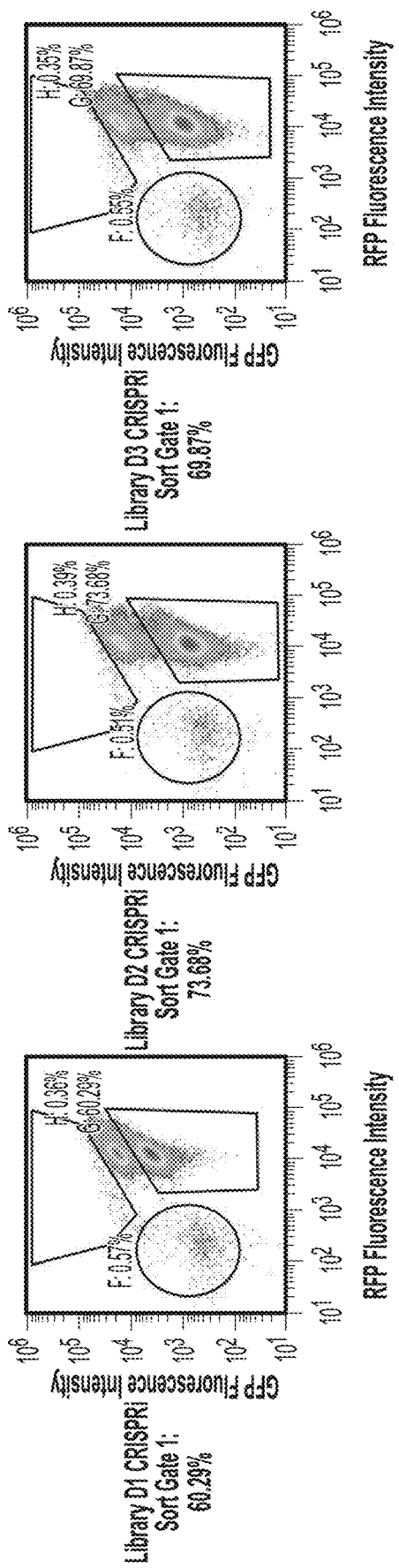
FIG. 51 is dot plot graphs showing the results of CRISPRi screens for mutations in libraries D1, D2, and D3, as described in Example 24. In the absence of CRISPRi, *E. coli* constitutively express both GFP and RFP, resulting in intense fluorescence in both wavelengths, represented by dots in the upper-right region of the plot. CasX proteins resulting in CRISPRi of GFP can reduce green fluorescence by >10-fold, while leaving red fluorescence unaltered, and these cells fall within the indicated Sort Gate 1. The total fraction of cells exhibiting CRISPRi is indicated.
Figure 52:
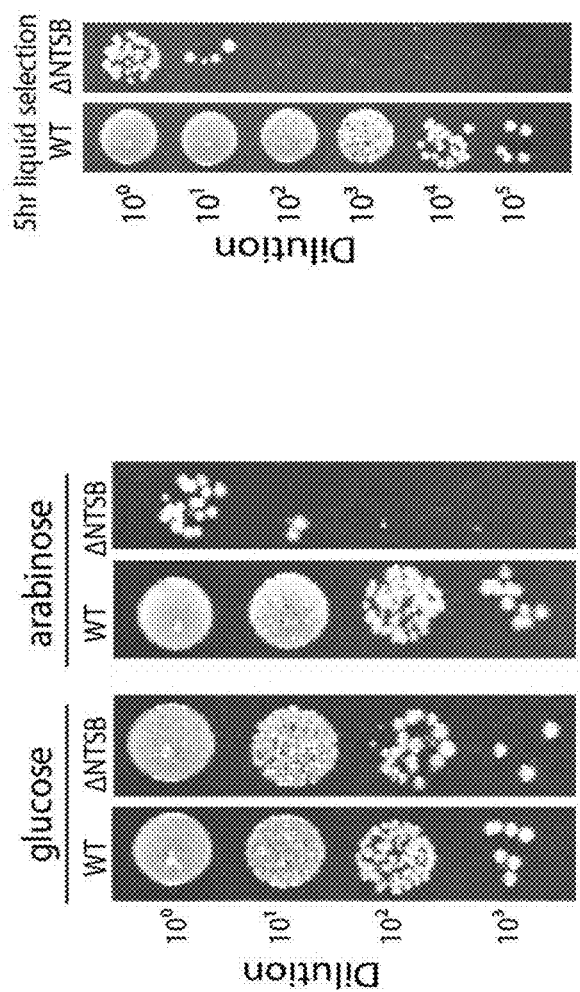
FIG. 52 is photographs of colonies grown in the ccdB assay, as described in Example 24. 10-fold dilutions were assayed in the presence of glucose or arabinose to induce expression of the ccdB toxin, resulting in approximately a 1000-fold difference between functional and nonfunctional proteins. When grown in liquid culture, the resolving power was approximately 10,000-fold, as seen on the right-hand side.

Four libraries of CasX protein variants were constructed using plasmid recombineering in E. coli strain EcNR2 (Addgene ID: 26931), and the overall approach to protein mutagenesis was termed Deep Mutational Evolution (DME), which is schematically shown in FIG. 50. Three libraries were constructed corresponding to each of three cleavage-inactivating mutations made to the reference CasX protein open reading frame of Planctomycetes, SEQ ID NO:2 ("STX2"), rendering the CasX catalytically dead (dCasX). These three mutations are referred to as D1 (with a D659A substitution), D2 (with an E756A substitution), or D3 (with a D922A substitution). A fourth library was composed of all three mutations in combination, referred to as DDD (D659A; E756A; D922A substitutions). These libraries were constructed by introducing desired mutations to each of the four starting plasmids. Briefly, an oligonucleotide library was obtained from Twist Biosciences and prepared for recombineering (see below). A final volume of 50 µL of 1 µM oligonucleotides, plus 10 ng of pSTX1 encoding the dCasX open reading frame (composed of either D1, D2, or D3) was electroporated into 50 µL of induced, washed, and concentrated EcNR2 using a 1 mm electroporation cuvette (BioRad GenePulser). A Harvard Apparatus ECM 630 Electroporation System was used with settings 1800 kV, 200 Ω, 25 µF. Three replicate electroporations were performed, then individually allowed to recover at 30° C. for 2 hr in 1 mL of SOC (Teknova) without antibiotic. These recovered cultures were titered on LB plates with kanamycin to determine the library size. 2XYT media and kanamycin was then added to a final volume of 6 mL and grown for a further 16 hours at 30° C. Cultures were miniprepped (QIAprep Spin® Miniprep Kit) and the three replicates were then combined, completing a round of plasmid recombineering. A second round of recombineering was then performed, using the resulting miniprepped plasmid from round 1 as the input plasmid.

Oligo library synthesis and maturation: A total of 57751 unique oligonucleotide sequences designed to result in either amino acid insertion, substitution, or deletion at each codon position along the STX 2 open reading frame were synthesized by Twist Biosciences, among which were included so-called 'recombineering oligos' that included one codon to represent each of the twenty standard amino acids and codons with flanking homology when encoded in the plasmid pSTX1. The oligo library included flanking 5' and 3' constant regions used for PCR amplification. Compatible PCR primers include oSH7: 5'AACACGTCCGTCCTAGAACT (universal forward; SEQ ID NO: 3613) and oSH8: 5'ACTTGGTTACGCTCAACACT (universal reverse; SEQ ID NO: 3614) (see reference table). The entire oligo pool was amplified as 400 individual 100 μL reactions. The protocol was optimized to produce a clean band at 164 bp. Finally, amplified oligos were digested with a restriction enzyme (to remove primer annealing sites, which would otherwise form scars during recombineering), and then cleaned, for example, with a PCR clean-up kit (to remove excess salts that may interfere with the electroporation step). Here, a 600 μL final volume BsaI restriction digest was performed, with 30 μg DNA+30 μL BsaI enzyme, which was digested for two hours at 37° C.

For DME1: after two rounds of recombineering were completed, plasmid libraries were cloned into a bacterial expression plasmid, pSTX2. This was accomplished using a BsmbI Golden Gate Cloning approach to subclone the library of STX genes into an expression compatible context, resulting in plasmid pSTX3. Libraries were transformed into Turbo® *E. coli* (New England Biolabs) and grown in chloramphenicol for 16 hours at 37° C., followed by miniprep the next day.

For DME2: protein libraries from DME1 were further cloned to generate a new set of three libraries for further screening and analysis. All subcloning and PCR was accomplished within the context of plasmid pSTX1. Library D1 was discontinued and libraries D2 and D3 were kept the same. A new library, DDD, was generated from libraries D2 and D3 as follows. First, libraries D2 and D3 were PCR amplified such that the Dead 1 mutation, E756A, was added to all plasmids in each library, followed by blunt ligation, transformation, and miniprep, resulting in library A (D1+D2) and library B (D1+D3). Next, another round of PCR was performed to add either mutation D3 or D2, respectively, to library A and B, generating PCR products A' and B'. At this point, A' and B' were combined in equimolar amounts, then blunt ligated, transformed, and minipreped to generate a new library, DDD, containing all three dead mutations in each plasmid.

Bacterial CRISPR Interference (CRISPRi) Screen

A dual-color fluorescence reporter screen was implemented, using monomeric Red Fluorescent Protein (mRFP) and Superfolder Green Fluorescent Protein (sfGFP), based on Qi L S, et al. Cell 152:1173-1183 (2013). This screen was utilized to assay gene-specific transcriptional repression mediated by programmable DNA binding of the CasX system. This strain of *E. coli* expresses bright green and red fluorescence under standard culturing conditions or when grown as colonies on agar plates. Under a CRISPRi system, the CasX protein is expressed from an anhydrotetracycline (aTc)-inducible promoter on a plasmid containing a p15A replication origin (plasmid pSTX3; chloramphenicol resistant), and the sgRNA is expressed from a minimal constitutive promoter on a plasmid containing a ColE1 replication origin (pSTX4, non-targeting spacer, or pSTX5, GFP-targeting spacer #1; carbenicillin resistant). When the CRISPRi *E. coli* strain is co-transformed with both plasmids, genes targeted by the spacer in pSTX4 are repressed; in this case GFP repression is observed, the degree to which is dependent on the function of the targeting CasX protein and sgRNA. In this system, RFP fluorescence can serve as a normalizing control. Specifically, RFP fluorescence is unaltered and independent of functional CasX based CRISPRi activity. CRISPRi activity can be tuned in this system by regulating the expression of the CasX protein; here, all assays used an induction concentration of 20 nM aTc final concentration in growth media.

Libraries of CasX protein were initially screened using the above CRISPRi system. After co-transformation and recovery, libraries were either: 1) plated on LB agar plus appropriate antibiotics and titered such that individual colonies could be picked, or 2) grown for eight hours in 2XYT media with appropriate antibiotics and sorted on a MA900 flow cytometry instrument (Sony). Variants of interest were detected using either standard Sanger sequencing of picked colonies (UC Berkeley Barker Sequencing Facility) or NGS sequencing of miniprepped plasmid (Massachusetts General Hospital CCIB DNA Core Next-Generation Sequencing Service).

Plasmids were minipreped and the protein sequence was PCR-amplified, then tagmented using a Nextera kit (Illumina) to fragment the amplicon and introduce indexing adapters for sequencing on a 150 paired end HiSeq™ 2500 (UC Berkeley Genomics Sequencing Lab).

Bacterial ccdB Plasmid Clearance Selection

A dual-plasmid selection system was used to assay clearance of a toxic plasmid by CasX DNA cleavage. Briefly, the arabinose-inducible plasmid pBLO63.3 expressing toxic protein ccdB results in death when transformed into *E. coli* strain BW25113 and grown under permissive conditions. However, growth is rescued if the plasmid is cleared successfully by dsDNA cleavage, and in particular by plasmid pSTX3 co-expressing CasX protein and a guide RNA targeting the plasmid pBLO63.3. CasX protein libraries from DME1, without the catalytically inactivating mutations D1, D2, or D3, were subcloned into plasmid pSTX3. These plasmid libraries were transformed into BW25113 carrying pBLO63.3 by electroporation (200 ng of plasmid into 50 uL of electrocompetent cells) and allowed to recover in 2 mL of SOC media at 37° C. at 200 rpm shaking for 25 minutes, after which 1 uL of 1M IPTG was added. Growth was continued for an additional 40 minutes, after which cultures were evenly divided across a 96-well deep-well block and grown in selective media for 4.5 hrs at 37° C. or 45° C. at 750 rpm. Selective media consists of the following: 2XYT with chloramphenicol+10 mM arabinose+500 μM IPTG+2 nM aTc (concentrations final). Following growth, plasmids were minipreped to complete one round of selection, and the resulting DNA was used as input for a subsequent round. Seven rounds of selection were performed on CasX protein libraries. CasX variant Sanger sequencing or NGS was performed as described above.

NGS Data Analysis

Paired end reads were trimmed for adapter sequences with cutadapt (version 2.1), and aligned to the reference with bowtie2 (v2.3.4.3). The reference was the entire amplicon sequence prior to tagmentation in the Nextera protocol. Each catalytically inactive CasX variant was aligned to its respective amplicon sequence. Sequencing reads were assessed for amino acid variation from the reference sequence. In short, the read sequence and aligned reference sequence were translated (in frame), then realigned and amino acid variants were called. Reads with poor alignment or high error rates were discarded (mapq<20 and estimated error rate >4%; Estimated error rate was calculated using per-base phred quality scores). Mutations at locations of poor-quality sequencing were discarded (phred score <20). Mutations were labeled for being single substitutions, insertions, or deletions, or other higher-order mutations, or outside the protein-coding sequence of the amplicon. The number of reads that supported each set of mutations was determined. These read counts were normalized for sequencing depth (mean normalization), and read counts from technical replicates were averaged by taking the geometric mean. Enrichment was calculated within each CasX variant by averaging the enrichment for each gate.

Molecular Biology of Variants

In order to screen variants of interest, individual variants were constructed using standard molecular biology techniques. All mutations were built on STX2 using a staging vector and Gibson cloning. To build single mutations, universal forward (5'→3') and reverse (3'→5') primers were designed on either end of the protein sequence that had homology to the desired backbone for screening (see Table 18). Primers to create the desired mutations were also designed (F primer and its reverse complement) and used with the universal F and R primers for amplification, thus producing two fragments. In order to add multiple mutations, additional primers with overlap were designed and more PCR fragments were produced. For example, to construct a triple mutant, four sets of F/R primers were designed. The resulting PCR fragments were gel extracted and the screening vector was digested with the appropriate restriction enzymes then gel extracted. The insert fragments and vector were then assembled using Gibson Assembly® master mix, transformed, and plated using appropriate LB agar+antibiotic. The clones were Sanger sequenced and correct clones were chosen.

Finally, spacer cloning was performed to target the guide RNA to a gene of interest in the appropriate assay or screen. The sequence verified non-targeting clone was digested with the appropriate golden gate enzyme and cleaned using DNA Clean and Concentrator kit (Zymo). The oligos for the spacer of interest were annealed. The annealed spacer was ligated into digested and cleaned vector using a standard Golden Gate Cloning protocol. The reaction was transformed and plated on LB agar+antibiotic. The clones were sanger sequenced and correct clones were chosen.

FB medium and cultured in a 37° C. incubator with 5% C02. The following day, confluence of seeded cells was checked. Cells were ~75% confluent at time of transfection. Each CasX construct was transfected at 100-500 ng per well using Lipofectamine™ 3000 following the manufacturer's protocol, into 3 wells per construct as replicates. SaCas9 and SpyCas9 targeting the appropriate gene were used as benchmarking controls. For each Cas protein type, a non-targeting plasmid was used as a negative control. After 24-48 hours of puromycin selection at 0.3-3 µg/ml to select for successfully transfected cells, followed by 1-7 days of recovery in FB medium, GFP fluorescence in transfected cells was analyzed via flow cytometry. In this process, cells were gated for the appropriate forward and side scatter, selected for single cells and then gated for reporter expression (Attune Nxt Flow Cytometer, Thermo Fisher Scientific) to quantify the expression levels of fluorophores. At least 10,000 events were collected for each sample. The data were then used to calculate the percentage of edited cells.

GFP Editing by Lentivirus Transduction of HEK293T Cells

Lentivirus products of plasmids encoding CasX proteins, including controls, CasX variants, and/or CasX libraries, were generated in a Lenti-X 293T Cell Line (Takara) following standard molecular biology and tissue culture techniques. Either iGFP HEK293T cells or SOD1-GFP reporter HEK293T cells were transduced using lentivirus based on standard tissue culture techniques. Selection and fluorescence analysis was performed as described above, except the recovery time post-selection was 5-21 days. For Fluorescence-Activated Cell Sorting (FACS), cells were gated as described above on a MA900 instrument (Sony). Genomic DNA was extracted by QuickExtract™ DNA Extraction Solution (Lucigen) or Genomic DNA Clean & Concentrator (Zymo).

Engineering of CasX Protein 2 to CasX 119

Prior work had demonstrated that CasX RNP complexes composed of functional wild-type CasX protein from Planctomycetes (hereafter referred to as CasX protein 2 {or STX2, or STX protein 2, SEQ ID NO: 2} and CasX sgRNA 1 {or STX sgRNA 1, SEQ ID NO: 4}) are capable of inducing dsDNA cleavage and gene editing of mammalian genomes (Liu, J J et al Nature, 566, 218-223 (2019)). However, previous observations of cleavage efficiency were relatively low (~30% or less), even under optimal laboratory conditions. These poor rates of genome editing may be insufficient for the wild-type CasX CRISPR systems to serve as therapeutic genome-editing molecules. In order to efficiently perform genome editing, the CasX protein must

TABLE 18

Primer sequences

| Screening vector | F primer sequence | R primer sequence |
|---|---|---|
| pSTX6 | SAH24:<br>TTCAGGTTGGACCGGTGCCACCATGGCCCC<br>AAAGAAGAAGCGGAAGGTCAGCCAAGAG<br>ATCAAGAGAATCAACAAGATCAGA (SEQ<br>ID NO: 3615) | SAH25:<br>TTTTGGACTAGTCACGGCGGGC<br>TTCCAG (SEQ ID NO: 3616) |
| pSTX116 or pSTX34 | oIC539:<br>ATGGCCCCAAAGAAGAAGCGGAAGGTCTC<br>TAGACAAG (SEQ ID NO: 3617) | oIC540:<br>TACCTTTCTCTTCTTTTTGGAC<br>TAGTCACGG (SEQ ID NO: 3618) |

GFP Editing by Plasmid Lipofection of HEK293T Cells

Either doxycycline inducible GFP (iGFP) reporter HEK293T cells or SOD1-GFP reporter HEK293T cells were seeded at 20-40 k cells/well in a 96 well plate in 100 µl of effectively perform two central functions: (i) form and stabilize the R-loop, and (ii) position the nuclease domain for cleavage of both DNA strands. Under conditions in which CasX RNP can access genomic DNA, genome editing rates will be partly governed by the ability of the CasX protein to perform these functions (the other controlling component being the guide RNA). The optimization of both functions is dependent on the complex sequence-function relationship between the linear chain of amino acids encoding the CasX protein and the biochemical properties of the fully formed, cleavage competent RNP. As amino acid mutations that enhance each of these functions can be combined to cumulatively result in a highly engineered CasX protein exhibiting greatly enhanced genome editing efficiency sufficient for human therapeutics, an overall engineering approach was devised in which mutations enhancing function (i) were identified, mutations enhancing function (ii) were identified, and then rational stacking (or combination) of multiple beneficial mutations would be used to construct CasX variants capable of efficient genome editing. Function (i), stabilization of the R-loop, is by itself sufficient to interfere with gene expression in living cells even in the absence of DNA nuclease activity, a phenomenon known as CRISPR interference (CRISPRi). It was determined that a bacterial CRISPRi assay would be well-suited to identifying mutations enhancing this function. Similarly, a bacterial assay testing for double-stranded DNA (dsDNA) cleavage would be capable of identifying mutations enhancing function (ii). A toxic plasmid clearance assay was chosen to serve as a bacterial selection strategy and identify relevant amino acid changes. These sets of mutations were then validated to provide an enhancement to human genome editing activity, and served as the foundation for more extensive and rational combinatorial testing across increasingly stringent assays.

The identification of mutations enhancing core functions was performed in an engineering cycle of protein library design, molecular biology construction of libraries, and high-throughput assay of the libraries. Potential improved variants of the STX2 protein were either identified by NGS of a high-throughput biological assay, sequenced directly as clones from a population, or designed de novo for specific hypothesis testing. For high-throughput assays of functions (i) or (ii), a comprehensive and unbiased design approach to mutagenesis was used for initial diversification. Plasmid recombineering was chosen as a sufficiently comprehensive and rapid method for library construction and was performed in a promoterless staging vector pSTX1 in order to minimize library bias throughout the cloning process. A comprehensive oligonucleotide pool encoded all possible single amino acid substitutions, insertions, and deletions in the STX2 sequence was constructed by DME; the first round of library construction and screening is hereafter referred to as DME1 (FIG. 50).Two high-throughput bacterial assays were chosen to identify potential improved variants from the diverse set of mutations in DME1. As discussed above, we reasoned that a CRISPRi bacterial screen would identify mutations enhancing function (i). While CRISPRi uses a catalytically inactive form of the CasX protein, many specific characteristics together influence the total enhancement of this function, such as expression efficiency, folding rate, protein stability, or stability of the R-loop (including binding affinity to the sgRNA or DNA). DME1 libraries were constructed on the dCasX mutant templates and individually screened. Screening was performed as Fluorescence-Activated Cell Sorting (FACS) of GFP repression in a previously validated dual-color CRISPRi scheme.

Results:

For each of the DME1, DME2 and DME3 libraries, the three libraries exhibited a different baseline CRISPRi activity, thereby serving as independent, yet related, screens. For each library, gates of varying stringency were drawn around the population of interest, and sorted cell populations were deep sequenced to identify CasX mutations enhancing GFP repression (FIG. 51). A second high-throughput bacterial assay was developed to assess dsDNA cleavage in *E. coli* by way of selection (see methods). When this assay is performed under selective conditions, a functional STX2 RNP can exhibit ~1000- to 10,000-fold increase in colony forming units compared to nonfunctional CasX protein (FIG. 52). Multiple rounds of liquid media selections were performed for the cleavage-competent libraries of DME1. Sequential rounds of colony picking and sequencing identified mutations to enhance function (ii). Several mutations were observed with increasing frequency with prolonged selection. One mutation of note, the deletion of proline 793, was first observed in round four at a frequency of two out of 36 sequenced colonies. After round five, the frequency increased to six out of 36 sequenced colonies. In round seven, it was observed in ten out of 48 sequenced colonies. This round-over-round enrichment suggested mutations observed in these assays could potentially enhance function (ii) of the CasX protein. Selected mutations observed across these assays can be found in table 19 as follows:

TABLE 19

| Selected mutations observed in bacterial assays for function (i) or (ii) | | | |
|---|---|---|---|
| Pos. | Ref. | Alt.* | Assay |
| 2 | Q | R | 45 C ccdb colony |
| 72 | T | S | D2 CRISPRi |
| 80 | A | T | 37 C ccdb colony |
| 111 | R | K | 45 C ccdb colony |
| 119 | G | C | 45 C ccdb colony |
| 121 | E | D | 37 C ccdb colony |
| 153 | T | I | 37 C ccdb colony |
| 166 | R | S | D2 CRISPRi |
| 203 | R | K | 45 C ccdb colony |
| 270 | S | W | 37 C ccdb colony |
| 346 | D | Y | 45 C ccdb colony |
| 361 | D | A | D1 CRISPRi |
| 385 | E | A | D3 CRISPRi |
| 386 | E | R | 45 C ccdb colony |
| 390 | K | R | D3 CRISPRi |
| 399 | F | L | 45 C ccdb colony |
| 421 | A | G | D2 CRISPRi |
| 433 | S | N | 45 C ccdb colony |
| 489 | D | S | D3 CRISPRi |
| 536 | F | S | D3 CRISPRi |
| 546 | I | V | D2 CRISPRi |
| 552 | E | A | D3 CRISPRi |
| 591 | R | I | 37 C ccdb colony |
| 595 | E | G | D3 CRISPRi |
| 636 | A | D | D3 CRISPRi |
| 657 | — | G | D1 CRISPRi |
| 661 | — | L | D1 CRISPRi |
| 661 | — | A | D1 CRISPRi |
| 663 | N | S | D1 CRISPRi |
| 679 | S | N | D2 CRISPRi |
| 695 | G | H | 45 C ccdb colony |
| 696 | — | P | 45 C ccdb colony |
| 707 | A | D | D3 CRISPRi |
| 708 | A | K | 45 C ccdb colony |
| 712 | D | Q | 37 C ccdb colony |
| 732 | D | P | D1 CRISPRi |
| 751 | A | S | D3 CRISPRi |
| 774 | — | G | Dl CRISPRi |
| 788 | A | W | D2 CRISPRi |
| 789 | Y | T | D1 CRISPRi |
| 789 | Y | D | D2 CRISPRi |
| 791 | C | M | 45 C ccdb colony |
| 792 | L | E | 45 C ccdb colony |
| 793 | P | — | 45 C ccdb colony |
| 793 | — | AS | 45 C ccdb colony |
| 793 | P | T | 45 C ccdb colony |

TABLE 19-continued

Selected mutations observed in bacterial assays for function (i) or (ii)

| Pos. | Ref. | Alt.* | Assay |
|---|---|---|---|
| 793 | P | — | D1 CRISPRi |
| 793 | — | — | D2 CRISPRi |
| 794 | — | PG | 45 C ccdb colony |
| 794 | — | PS | 45 C ccdb colony |
| 795 | — | AS | 37 C ccdb colony |
| 795 | — | AS | 45 C ccdb colony |
| 796 | — | AG | 37 C ccdb colony |
| 797 | — | AS | 45 C ccdb colony |
| 797 | Y | L | 45 C ccdb colony |
| 799 | S | A | D3 CRISPRi |
| 867 | S | G | 45 C ccdb colony |
| 889 | — | L | 37 C ccdb colony |
| 897 | L | M | 45 C ccdb colony |
| 922 | D | K | D1 CRISPRi |
| 963 | Q | P | D2 CRISPRi |
| 975 | K | Q | D2 CRISPRi |

*substitution, insertion, or deletion, positions are indicated relative to SEQ ID NO: 2
Pos.: Position;
Ref.: Reference;
Alt.: Alternative

* substitution, insertion, or deletion, positions are indicated relative to SEQ ID NO: 2 Pos.: Position; Ref.: Reference; Alt: Alternative The mutations observed in the bacterial assays above were selected for their potential to enhance CasX protein functions (i) or (ii), but desirable mutations will enhance at least one function while simultaneously remaining compatible with the other. To test this, mutations were tested for their ability to improve human cell genome editing activity overall, which requires both functions acting in concert. A HEK293T GFP editing assay was implemented in which human cells containing a stably-integrated inducible GFP (iGFP) gene were transduced with a plasmid that expresses the CasX protein and sgRNA 2 with spacers to target the RNP to the GFP gene. Mutations identified in bacterial screens, bacterial selections, as well as mutations chosen de novo from biochemical hypotheses resulting from inspection of the published Cryo-EM structure of the homologous DpbCasX protein, were tested for their relative improvement to human genome editing activity as quantified relative to the parent protein STX 2 (FIG. 53), with the greatest improvement demonstrated for construct 119, shown at the bottom of FIG. 53. Several dozen of the proposed function-enhancing mutations were found to improve human cell genome editing susbstantially, and selected mutations from these assays can be found in Table 20 as follows:

TABLE 20

Selected single mutations observed to enhance genome editing

| Position | Reference | Alternative* | Fold-Improvement (average of two GFP spacers) |
|---|---|---|---|
| 379 | L | R | 1.4 |
| 708 | A | K | 2.13 |
| 620 | T | P | 1.84 |
| 385 | E | P | 1.19 |
| 857 | Y | R | 1.95 |
| 658 | I | V | 1.94 |
| 399 | F | L | 1.64 |
| 404 | L | K | 2.23 |
| 793 | P | — | 1.23 |
| 252 | Q | K | 1.12** |

Figure 53:
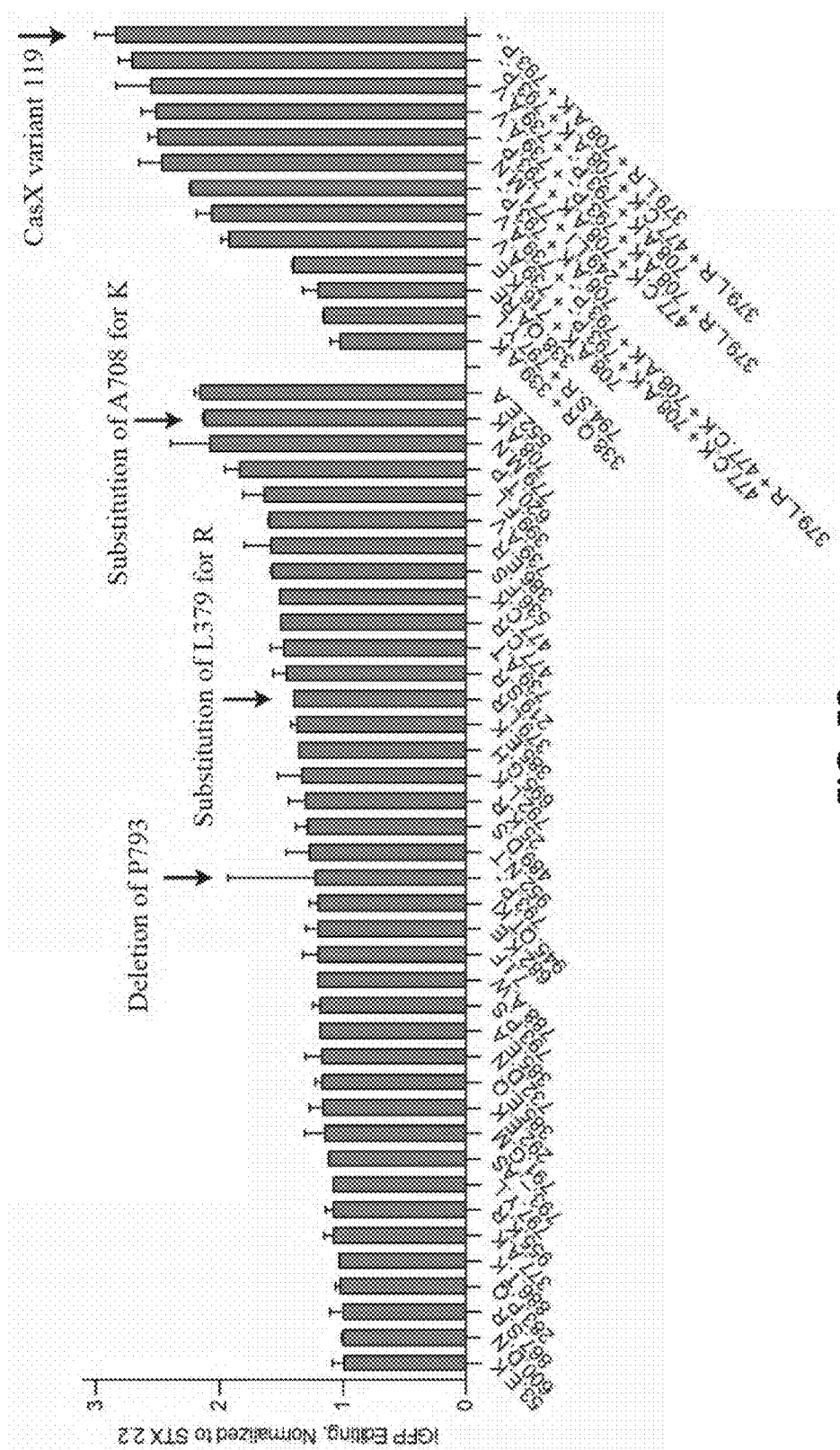
FIG. 53 is a graph of HEK iGFP genome editing efficiency testing CasX variants with sgRNA 2 (SEQ ID NO:5), with appropriate spacers, with data expressed as fold-improvement over the wild-type CasX protein (SEQ ID NO: 2) in the HEK iGFP editing assay, as described in Example 24. Single mutations are shown at the top, with groups of mutations shown at the bottom of the graph). Error bars combine internal measurement error (SD) and inter-experimental measurement error (SD across replicate experiments for those variants tested more than once), in at least triplicate assays.

*substitution, insertion, or deletion, positions relative to SEQ ID NO: 2
**calculated as the average improvement across four variants with and without the mutation The overall engineering approach taken here relies on the central hypothesis that individual mutations enhancing each function can be additively combined to obtain greatly enhanced CasX variants with improved editing capability, which was supported by the findings as described below; e.g., CasX variant 119 (indicated by the star in FIG. 54) exhibited a 23.9-fold improvement relative to the wild-type CasX. To test this, the single mutations were first identified if they enhanced overall editing activity. Of particular note here, a substitution of the hydrophobic leucine 379 in the helical II domain to a positively charged arginine resulted in a 1.40 fold-improvement in editing activity. This mutation might provide favorable ionic interactions with the nearby phosphate backbone of the DNA target strand (between PAM-distal bp 22 and 23), thus stabilizing R-loop formation and thereby enhancing function (i). A second hydrophobic to charged mutation, alanine 708 to lysine, increased editing activity by 2.13-fold, and might provide additional ionic interactions between the RuvC domain and the sgRNA 5' end, thus plausibly enhancing function (i) by increasing the binding affinity of the protein for the sgRNA and thereby increasing the rate of R-loop formation. The deletion of proline 793 improved editing activity by 1.23-fold by shortening a loop between an alpha helix and a beta sheet in the RuvC domain, potentially enhancing function (ii) by favorably altering nuclease positioning for dsDNA cleavage. Overall, several dozen single mutations were found to improve editing activity, including mutations identified from each of the bacterial assays as well as mutations proposed from de novo hypothesis generation. To further identify those mutations that enhanced function in a cooperative manner, rational CasX variants composed of combinations of multiple mutations were tested (FIG. 53). An initial small combinatorial set was designed and assayed, of which CasX variant 119 emerged as the overall most improved editing molecule, with a 2.8-fold improved editing efficiency compared to the STX2 wild-type protein. Variant 119 is composed of the three single mutations L379R, A708K, and [P793], demonstrating that their individual contributions to enhancement of function are additive.

SOD1-GFP Assay Development.

Figure 54:
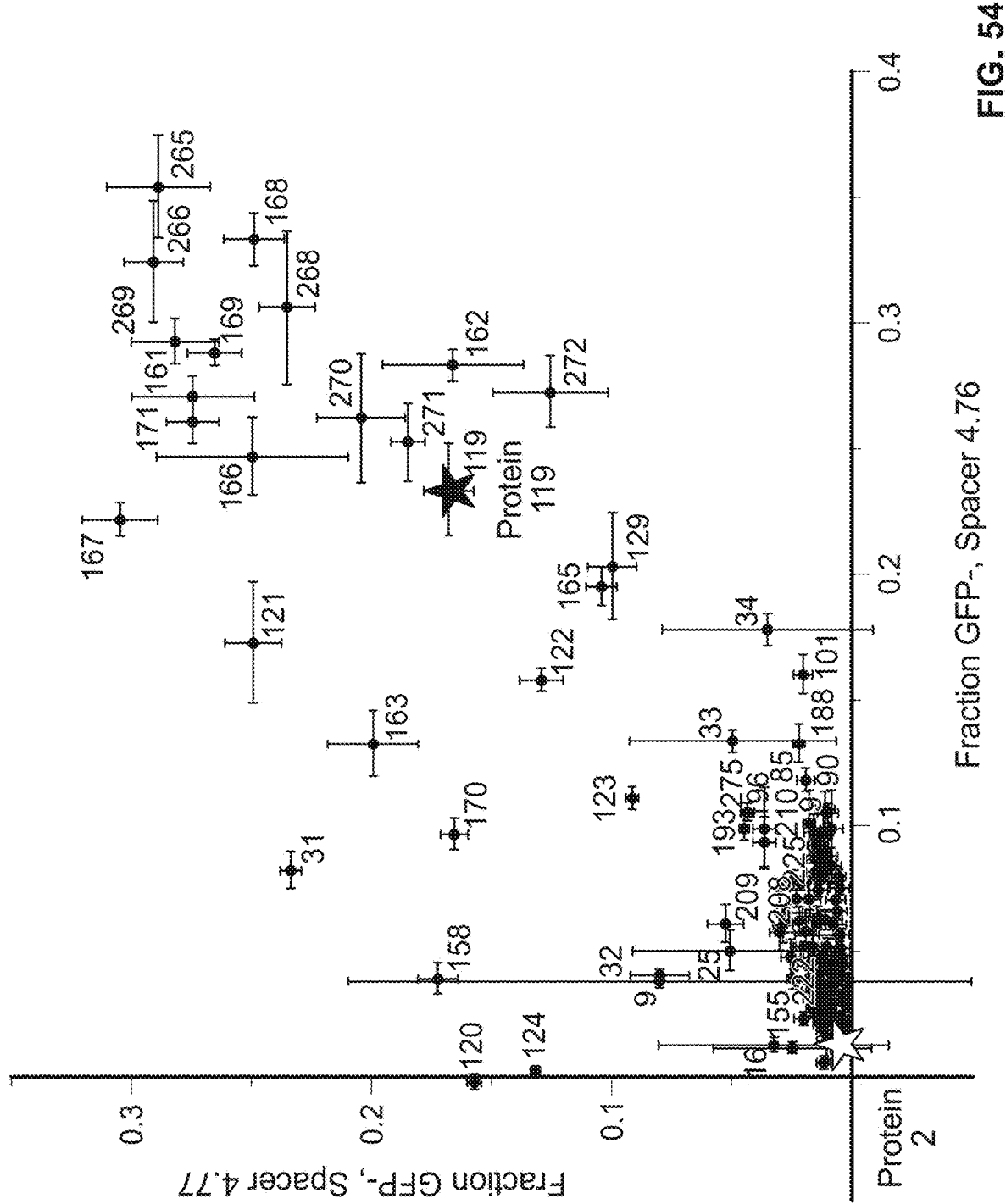
FIG. 54 is a scatterplot showing results of the SOD1-GFP reporter assay for CasX variants with sgRNA scaffold 2 utilizing two different spacers for GFP, as described in Example 24.

To assess CasX variants with greatly improved genome-editing activity, we sought to develop a more stringent genome editing assay. The iGFP assay provides a relatively facile editing target such that STX protein 2 in the assays above exhibited an average editing efficiency of 41% and 16% with GFP targeting spacers 4.76 and 4.77 respectively. As protein variants approach 2-fold or greater efficiency improvements, the assay becomes saturated. Therefore a new HEK293T cell line was developed with the GFP sequence integrated in-frame at the C-terminus of the endogenous human gene SOD1, termed the SOD1-GFP line. This cell line served as anew, more stringent, assay to measure the editing efficiency of several hundred additional CasX protein variants (FIG. 54). Additional mutations were identified from bacterial assays, including a second iteration of DME library construction and screening, as well as utilizing hypothesis-driven approaches. Further exploration of combinatorial improved variants was also performed in the SOD1-GFP assay.

Figure 55:
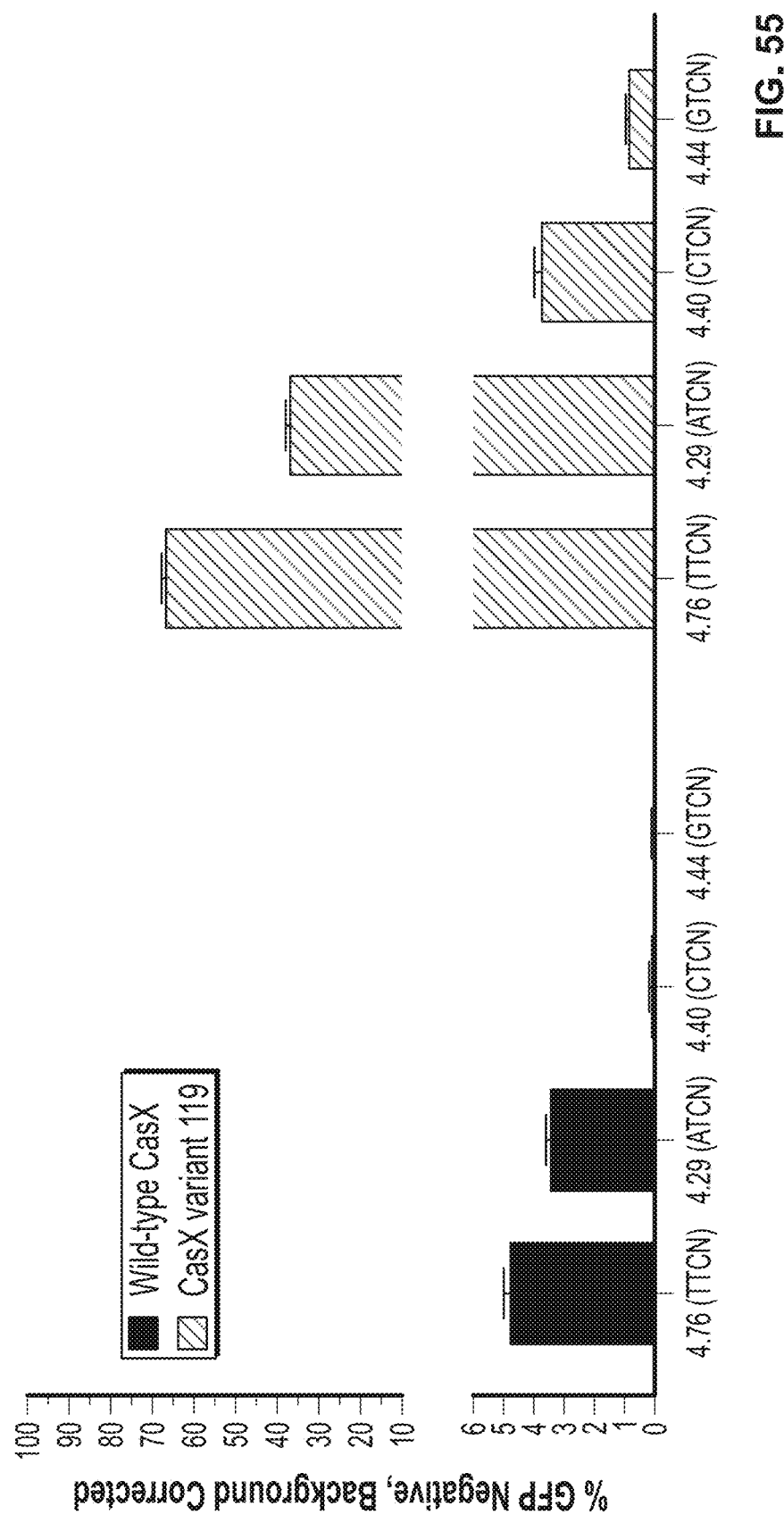
FIG. 55 is a graph showing the results of the HEK293 iGFP genome editing assay assessing editing across four different PAM sequences comparing wild-type CasX (SEQ ID NO: 2) and CasX variant 119; both utilizing sgRNA scaffold 1 (SEQ ID NO: 4), with spacers utilizing four different PAM sequences, as described in Example 24.

In light of the SOD1-GFP assay results, measured efficiency improvements were no longer saturated, and CasX variant 119 (indicated by the star in FIG. 54) exhibited a 23.9-fold improvement relative to the wild-type CasX (average of two spacers), with several constructs exhibiting enhanced activity relative to the CasX 119 construct. Alternatively, the dynamic range of the iGFP assay could be increased (though perhaps not completely unsaturated) by reducing the baseline activity of the WT CasX protein, namely by using sgRNA variant 1 rather than 2. Under these more stringent conditions of the iGFP assay, CasX variant 119 exhibited a 15.3-fold improvement relative to the wild-type CasX using the same spacers. Intriguingly, CasX variant 119 also exhibited substantial editing activity with spacers utilizing each of the four NTCN PAM sequences, while WT CasX only edited above 1% with spacers utilizing TTCN and ATCN PAM sequences (FIG. 55), demonstrating the ability of the CasX variant to effectively edit using an expanded spectrum of PAM sequences. CasX function enhancement by extensive combinatorial mutagenesis.

Potential improved variants tested in the variety of assays above provided a dataset from which to select candidate lead proteins. Over 300 proteins were assessed in individual clonal assays and of these, 197 single mutations were assessed; the remaining ~100 proteins contained combinatorial combinations of these mutations. Protein variants were assessed via three different assays (plasmid p6 by iGFP, plasmid p6 by SOD1-GFP, or plasmid p16 by SOD1-GFP). While single mutants led to significant improvements in the iGFP assay (with fraction GFP—greater than 50%), these single-mutants all performed poorly in the SOD1-GFP p6 backbone assay (fraction GFP—less than 10%). However, proteins containing multiple, stacked mutations were able to successfully inactivate GFP in this more stringent assay, indicating that stacking of improved mutations could substantially improve cleavage activity.

Individual mutations observed to enhance function often varied in their capacity to additively improve editing activity when combined with additional mutations. To rationally quantify these epistatic effects and further improve genome editing activity, a subset of mutations was identified that had each been added to a protein variant containing at least one other mutation, and where both proteins (with and without the mutation) were tested in the same experimental context (assay and spacer; 46 mutations total). To determine the effect due to that mutation, the fraction of GFP—cells was compared with and without the mutation. For each protein/experimental context, the mutation effect was quantified as: 1) substantially improving the activity ($f_v > 1.1 f_0$ where $f_0$ is the fraction GFP—without the mutation, and $f_v$ is the fraction GFP—with the mutation), 2) substantially worsening the activity ($f_v < 0.9 f_0$), or 3) not affecting activity (neither of the other conditions are met). An overall score per mutation was calculated (s), based on the fraction of protein/experiment contexts in which the mutation substantially improved activity, minus the fraction of contexts in which the mutation substantially worsened activity. Out of the 46 mutations obtained, only 13 were associated with consistently increased activity ($s \geq 0.5$), and 18 mutations substantially decreased activity ($s \leq -0.5$). Importantly, the distinction between these mutations was only clear when examining epistatic interactions across a variety of variant contexts: all of these mutations had comparable activity in the iGFP assay when measured alone.

The above quantitative analysis allowed the systematic design of an additional set of highly engineered CasX proteins composed of single mutations enhancing function both individually and in combination. First, seven out of the top 13 mutations were chosen to be stacked (the other 6 variants comprised the three variants A708K, [P793] and L379R that were included in all proteins, and another two that affected redundant positions; see FIG. 14). These mutations were iteratively stacked onto three different versions of the CasX protein: CasX 119, 311, and 365; proceeding to add only one mutation (e.g., Y857R), to adding several mutations in combination. In order to maximize the combination of enhancements for both function (i) and function (ii), individual mutations were rationally chosen to maintain a diversity of biochemical properties—i.e., multiple mutations that substitute a hydrophobic residue with a negatively charged residue were avoided. The resulting ~30 protein variants had between five and 10 individual mutations relative to STX2 (mode=7 mutations). The proteins were tested in a lipofection assay in a new backbone context (p34) with guide scaffold 64, and most showed improvement relative to protein 119. The most improved variant of this set, protein 438, was measured to be >20% improved relative to protein 119 (see Table 21 below).

Lentiviral Transduction iGFP Assay Development

Figure 56:
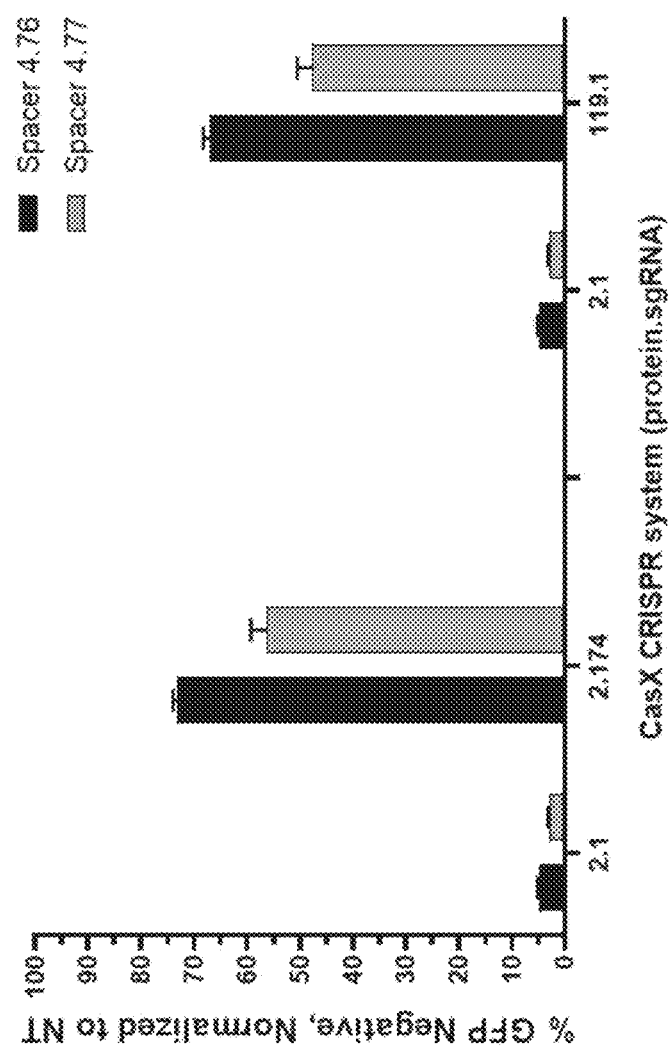
FIG. 56 is a graph showing the results of genome editing activity of CasX variant 119 and sgRNA 174 compared to wild-type CasX 2 and guide scaffold 1 in the iGFP lipofection assay utilizing two different spacers, as described in Example 24.
Figure 57:
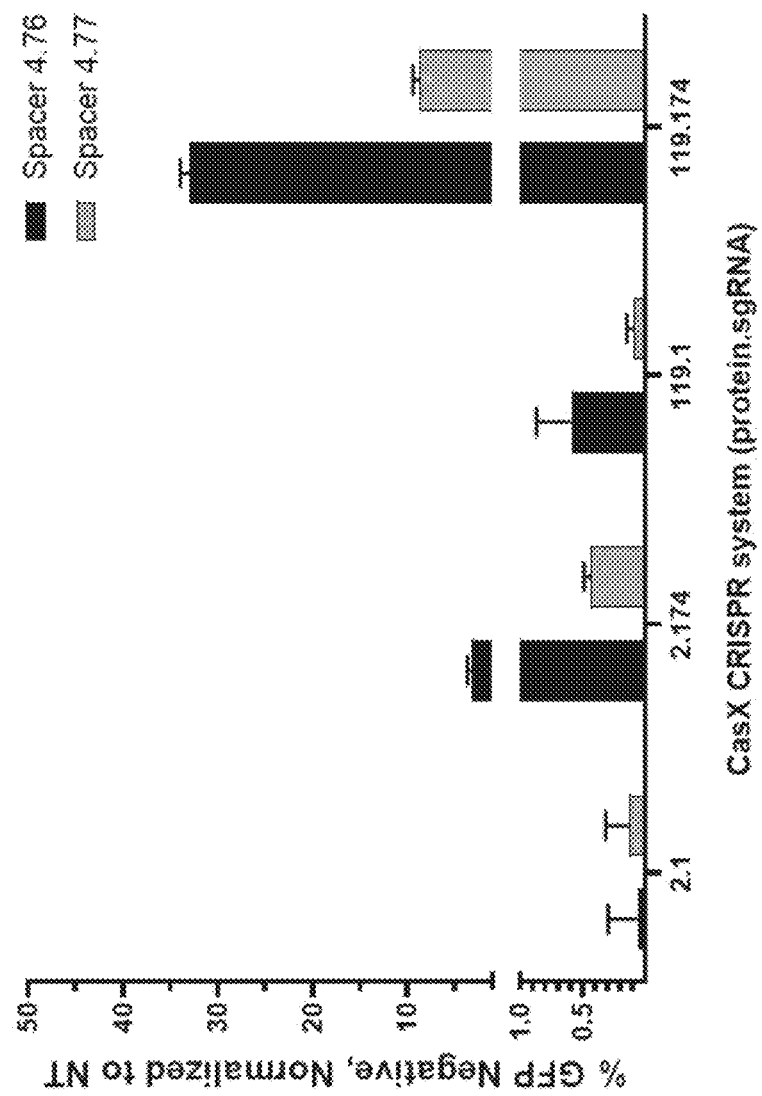
FIG. 57 is a graph showing the results of genome editing activity of CasX variant 119 and sgRNA 174 compared to wild-type CasX and guide in the iGFP lentiviral transduction assay, using two different spacers, as described in Example 24.

As discussed above regarding the iGFP assay, enhancements to the CasX system had likely resulted in the lipofection assay becoming saturated—that is, limited by the dynamic range of the measurement. To increase the dynamic range, a new assay was designed in which many fewer copies of the CasX gene are delivered to human cells, consisting of lentiviral transductions in a new backbone context, plasmid pSTX34 (see FIG. 35). Under this more stringent delivery modality, the dynamic range was sufficient to observe the improvements of CasX protein variant 119 in the context of a further improved sgRNA, namely sgRNA variant 174. Improved variants of both the protein and sgRNA were found to additively combine to produce yet further improved CasX CRISPR systems. Protein variant 119 and sgRNA variant 174 were each measured to improve iGFP editing activity by approximately an order of magnitude when compared with wild-type CasX protein 2 (SEQ ID NO: 2) in complex with sgRNA 1 (SEQ ID NO: 4) under the lipofection iGFP assay (FIG. 56). Moreover, improvements to editing activity from the protein and sgRNA appear to stack nearly linearly; while individually substituting CasX 2 for CasX 119, or substituting sgRNA 174 for sgRNA 1, produces a ten-fold improvement, substituting both simultaneously produces at least another ten-fold improvement (FIG. 57). Notably, this range of activity improvements exceeds the dynamic range of either assay. However, the overall activity improvement can be estimated by calculating the fold change relative to the sample 2.174, which was measured precisely in both assays. The enhancement of the highly engineered CasX CRISPR system 119.174 over wild type CasX CRISPR system 2.1 resulted in a 259-fold improvement in genome editing efficiency in human cells (+/−58, propagated standard deviation, as shown in FIG. 57), supporting that, under the conditions of the assay, the engineering of both the CasX and the guide led to dramatic improvements in editing efficiency compared to wild-type CasX and guide.

Engineering of Domain Exchange Variants

Figure 58:
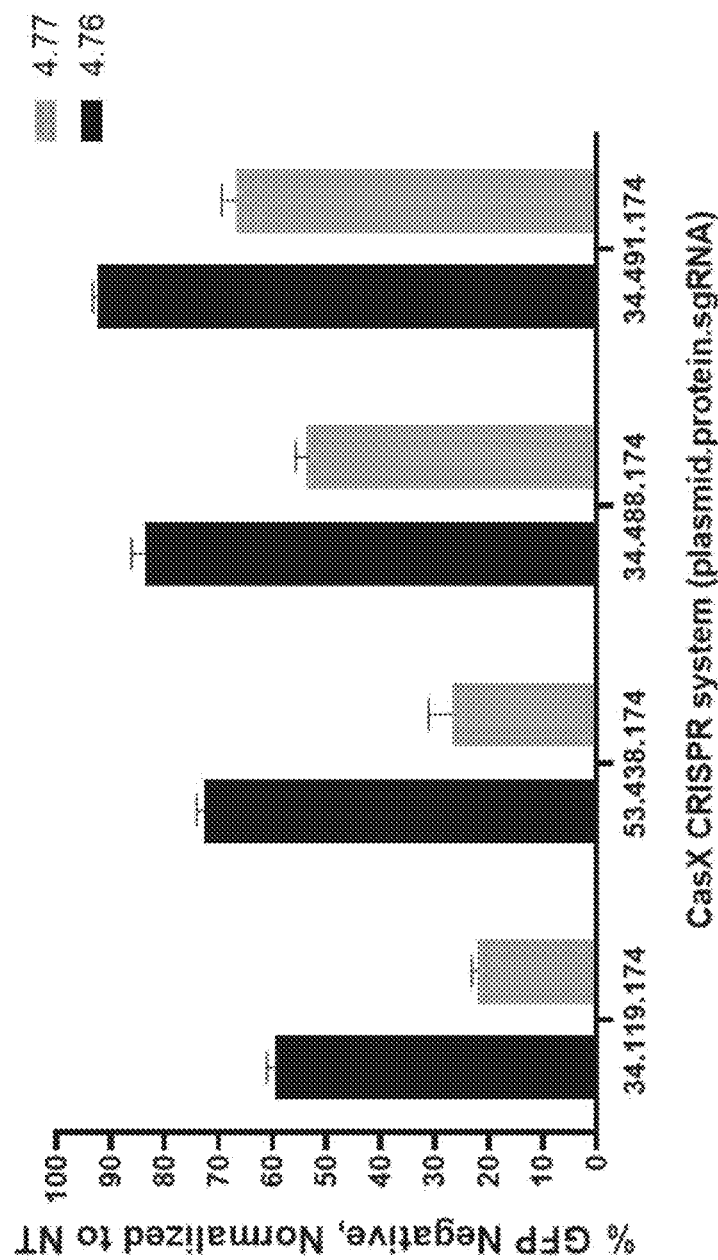
FIG. 58 is a graph showing the results of genome editing in the more stringent lentiviral assay to compare the editing activity of four CasX variants (119, 438, 488 and 491) and the optimized sgNA 174 and two different spacers, as described in Example 24. The results show the step-wise improvement in editing efficiency achieved by the additional modifications and domain swaps introduced to the starting-point 119 variant.

One problematic limitation of mutagenesis-based directed evolution is the combinatorial increase of the numbers of possible sequences that result as one takes larger steps in sequence-space. To overcome this, the swapping of protein domains from homologous sequences of different CasX proteins was evaluated as an alternative approach. To take advantage of the phylogenetic data available for the CasX CRISPR system, alignments were made between the CasX 1 (SEQ ID NO: 1) and CasX 2 (SEQ ID NO: 2) protein sequences, and domains were annotated for exchange in the context of improved CasX protein variant 119. To benchmark CasX 119 against the top designed combinatorial CasX protein variants and the top domain exchanged variants, all within the context of improved sgRNA 174, a stringent iGFP lentiviral transduction assay was performed. Protein variants from each class were identified as improved relative to CasX variant 119 (FIG. 58), and fold changes are represented in Table 21. For example, at day 13, CasX 119.174 with GFP spacer 4.76 leads to phenotype disruption in only ~60% of cells, while CasX variant 491 in the same context results in >90% phenotypic editing. To summarize, the compared proteins contained the following number of mutations relative to the WT CasX protein 2: 119=3 point mutations; 438=7 point mutations; 488=protein 119, with NTSB and helical Ib domains from CasX 1 (67 mutations total); 491=5 point mutations, with NTSB and helical Ib domains from CasX 1 (69 mutations total).

TABLE 21

CasX variant improvements over CasX variant 119 in the iGFP lentiviral transduction assay, in the context of improved sgRNA 174.

| Cas X Protein | Fold-change editing activity, spacer 4.76* | Fold-change editing activity, spacer 4.77* |
|---|---|---|
| 119 | 1.00 | 1.00 |
| 438 | 1.22 | 1.21 |
| 488 | 1.41 | 2.43 |
| 491 | 1.55 | 3.03 |

*relative to CasX 119

The results demonstrate that the application of rationally-designed libraries, screening, and analysis methods into a technique we have termed Deep Mutational Evolution to scan fitness landscapes of both the CasX protein and guide RNA enabled the identification and validation of mutations which enhanced specific functions, contributing to the improvement of overall genome editing activity. These datasets enabled the rational combinatorial design of further improved CasX and guide variants disclosed herein.

Example 25: Design and Evaluation of Improved Guide RNA Variants

The existing CasX platform based on wild-type sequences for dsDNA editing in human cells achieves very low efficiency editing outcomes when compared with alternative CRISPR systems (Liu, J J et al Nature, 566, 218-223 (2019)). Cleavage efficiency of genomic DNA is governed, in large part, by the biochemical characteristics of the CasX system, which in turn arise from the sequence-function relationship of each of the two components of a cleavage-competent CasX RNP: a CasX protein complexed with a sgRNA. The purpose of the following experiments was to create and identify gRNA scaffold variants with enhanced editing properties relative to wild-type CasX:gNA RNP through a program of comprehensive mutagenesis and rational approaches.

Methods

Methods for High-Throughput sgRNA Library Screens

1) Molecular Biology of sgRNA Library Construction

To build a library of sgRNA variants, primers were designed to systematically mutate each position encoding the reference gRNA scaffold of SEQ ID NO: 5, where mutations could be substitutions, insertions, or deletions. In the following in vivo bacterial screens for sgRNA mutations, the sgRNA (or mutants thereof) was expressed from a minimal constitutive promoter on the plasmid pSTX4. This minimal plasmid contains a ColE1 replication origin and carbenicillin antibiotic resistance cassette, and is 2311 base pairs in length, allowing standard Around-the-Horn PCR and blunt ligation cloning (using conventional methodologies). Forward primers KST223-331 and reverse primers KST332-440 tile across the sgRNA sequence in one base-pair increments and were used to amplify the vector in two sequential PCR steps. In step 1, 108 parallel PCR reactions were performed for each type of mutation, resulting in single base mutations at each designed position. Three types of mutations were generated. To generate base substitution mutations, forward and reverse primers were chosen in matching pairs beginning with KST224+KST332. To generate base insertion mutations, forward and reverse primers were chosen in matching pairs beginning with KST223+KST332. To generate base deletion mutations, forward and reverse primers were chosen in matching pairs beginning with KST225+KST332. After Step 1 PCR, samples were pooled into an equimolar manner, blunt-ligated, and transformed into Turbo E. coli (New England Biolabs), followed by plasmid extraction the next day. The resulting plasmid library theoretically contained all possible single mutations. In Step 2, this process of PCR and cloning was then repeated using the Step 1 plasmid library as the template for the second set of PCRs, arranged as above, to generate all double mutations. The single mutation library from Step 1 and the double mutation library from Step 2 were pooled together.

After the above cloning steps, the library diversity was assessed with next generation sequencing (see below section for methods) (see FIG. 59). It was confirmed that the majority of the library contained more than one mutation ('other') category. A substantial fraction of the library contained single base substitutions, deletions, and insertions (average representation within the library of 1/18,000 variants for single substitutions, and up to 1/740 variants for single deletions).

2) Assessing Library Diversity with Next Generation Sequencing.

For NGS analysis, genomic DNA was amplified via PCR with primers specific to the scaffold region of the bacterial expression vector to form a target amplicon. These primers contain additional sequence at the 5' ends to introduce Illumina read (see Table 22 for sequences). Typical PCR conditions were: 1× Kapa Hifi buffer, 300 nM dNTPs, 300 nM each primer, 0.75 ul of Kapa Hifi Hotstart DNA polymerase in a 50 µl reaction. On a thermal cycler, incubate for 95° C. for 5 min; then 16-25 cycles of 98° C. for 15 s, 60° C. for 20 s, 72° C. for 1 min; with a final extension of 2 min at 72° C. Amplified DNA product was purified with Ampure XP DNA cleanup kit, with elution in 30 µl of water. A second PCR step was done with indexing adapters to allow multiplexing on the Illumina platform. 20 µl of the purified product from the previous step was combined with 1× Kapa GC buffer, 300 nM dNTPs, 200 nM each primer, 0.75 μl of Kapa Hifi Hotstart DNA polymerase in a 50 μl reaction. On a thermal cycler, cycle for 95° C. for 5 min; then 18 cycles of 98° C. for 15 s, 65° C. for 15 s, 72° C. for 30 s; with a final extension of 2 min at 72° C. Amplified DNA product was purified with Ampure XP DNA cleanup kit, with elution in 30 μl of water. Quality and quantification of the amplicon was assessed using a Fragment Analyzer DNA analyzer kit (Agilent, dsDNA 35-1500 bp).

TABLE 22 primer sequences.

| Primer | SEQ ID NO |
| --- | --- |
| PCR1 Fwd | 3619 |
| PCR2 Rvs | 3620 |
| PCR2 Fwd | 3621 |
| PCR2 Rvs v1 001 | 3622 |
| PCR2_Rvs_v1_002 | 4294 |
| PCR2_Rvs_v1_003 | 4295 |
| PCR2_Rvs_v1_004 | 4296 |
| PCR2_Rvs_v1_005 | 4297 |
| PCR2_Rvs_v1_006 | 4298 |
| PCR2_Rvs_v1_007 | 4299 |
| PCR2_Rvs_v1_008 | 4300 |
| PCR2_Rvs_v1_009 | 4301 |
| PCR2_Rvs_v1_010 | 4302 |
| PCR2_Rvs_v1_011 | 4303 |
| PCR2_Rvs_v1_012 | 4304 |
| PCR2_Rvs_v1_013 | 4305 |
| PCR2_Rvs_v1_014 | 4306 |
| PCR2_Rvs_v1_015 | 4307 |
| PCR2_Rvs_v1_016 | 4308 |
| PCR2_Rvs_v1_017 | 4309 |
| PCR2_Rvs_v1_018 | 4310 |
| PCR2_Rvs_v1_019 | 4311 |
| PCR2_Rvs_v1_020 | 4312 |
| PCR2_Rvs_v1_021 | 4313 |
| PCR2_Rvs_v1_022 | 4314 |
| PCR2_Rvs_v1_023 | 4315 |
| PCR2_Rvs_v1_024 | 4316 |
| PCR2_Rvs_v1_025 | 4317 |
| PCR2_Rvs_v1_026 | 4318 |
| PCR2_Rvs_v1_027 | 4319 |
| PCR2_Rvs_v1_028 | 4320 |
| PCR2_Rvs_v1_029 | 4321 |
| PCR2_Rvs_v1_030 | 4322 |
| PCR2_Rvs_v1_031 | 4323 |
| PCR2_Rvs_v1_032 | 4324 |
| PCR2_Rvs_v1_033 | 4325 |
| PCR2_Rvs_v1_034 | 4326 |
| PCR2_Rvs_v1_035 | 4327 |
| PCR2_Rvs_v1_036 | 4328 |
| PCR2_Rvs_v1_037 | 4329 |
| PCR2_Rvs_v1_038 | 4330 |
| PCR2_Rvs_v1_039 | 4331 |
| PCR2_Rvs_v1_040 | 4332 |
| PCR2_Rvs_v1_041 | 4333 |
| PCR2_Rvs_v1_042 | 4334 |
| PCR2_Rvs_v1_043 | 4335 |
| PCR2_Rvs_v1_044 | 4336 |
| PCR2_Rvs_v1_045 | 4337 |
| PCR2_Rvs_v1_046 | 4338 |
| PCR2_Rvs_v1_047 | 4339 |
| PCR2_Rvs_v1_048 | 4340 |
| PCR2_Rvs_v2_001 | 4341 |
| PCR2_Rvs_v2_002 | 4342 |
| PCR2_Rvs_v2_003 | 4343 |
| PCR2_Rvs_v2_004 | 4344 |
| PCR2_Rvs_v2_005 | 4345 |
| PCR2_Rvs_v2_006 | 4346 |
| PCR2_Rvs_v2_007 | 4347 |
| PCR2_Rvs_v2_008 | 4348 |
| PCR2_Rvs_v2_009 | 4349 |
| PCR2_Rvs_v2_010 | 4350 |
| PCR2_Rvs_v2_011 | 4351 |
| PCR2_Rvs_v2_012 | 4352 |
| PCR2_Rvs_v2_013 | 4353 |

TABLE 22-continued primer sequences.

| Primer | SEQ ID NO |
| --- | --- |
| PCR2_Rvs_v2_014 | 4354 |
| PCR2_Rvs_v2_015 | 4355 |
| PCR2_Rvs_v2_016 | 4356 |
| PCR2_Rvs_v2_017 | 4357 |
| PCR2_Rvs_v2_018 | 4358 |
| PCR2_Rvs_v2_019 | 4359 |
| PCR2_Rvs_v2_020 | 4360 |
| PCR2_Rvs_v2_021 | 4361 |
| PCR2_Rvs_v2_022 | 4362 |
| PCR2_Rvs_v2_023 | 4363 |
| PCR2_Rvs_v2_024 | 4364 |
| PCR2_Rvs_v2_025 | 4365 |
| PCR2_Rvs_v2_026 | 4366 |
| PCR2_Rvs_v2_027 | 4367 |
| PCR2_Rvs_v2_028 | 4368 |
| PCR2_Rvs_v2_029 | 4369 |
| PCR2_Rvs_v2_030 | 4370 |
| PCR2_Rvs_v2_031 | 4371 |
| PCR2_Rvs_v2_032 | 4372 |
| PCR2_Rvs_v2_033 | 4373 |
| PCR2_Rvs_v2_034 | 4374 |
| PCR2_Rvs_v2_035 | 4375 |
| PCR2_Rvs_v2_036 | 4376 |
| PCR2_Rvs_v2_037 | 4377 |
| PCR2_Rvs_v2_038 | 4378 |
| PCR2_Rvs_v2_039 | 4379 |
| PCR2_Rvs_v2_040 | 4380 |
| PCR2_Rvs_v2_041 | 4381 |
| PCR2_Rvs_v2_042 | 4382 |
| PCR2_Rvs_v2_043 | 4383 |
| PCR2_Rvs_v2_044 | 4384 |
| PCR2_Rvs_v2_045 | 4385 |
| PCR2_Rvs_v2_046 | 4386 |
| PCR2_Rvs_v2_047 | 4387 |
| PCR2_Rvs_v2_048 | 4388 |
| PCR2_fwd_v1_univ | 4389 |
| PCR2_fwd_v2_univ | 4390 |
| PCR2_fwd_v2_001 | 4391 |
| PCR2_fwd_v2_002 | 4392 |
| PCR2_fwd_v2_003 | 4393 |
| PCR2_fwd_v2_004 | 4394 |
| PCR2_fwd_v2_005 | 4395 |
| PCR2_fwd_v2_006 | 4396 |
| PCR2_fwd_v2_007 | 4397 |
| PCR2_fwd_v2_008 | 4398 |
| PCR2_fwd_v2_009 | 4399 |
| PCR2_fwd_v2_010 | 4400 |
| PCR2_fwd_v2_011 | 4401 |
| PCR2_fwd_v2_012 | 4402 |

3) Bacterial CRISPRi (CRISPR Interference) Assay

A dual-color fluorescence reporter screen was implemented, using monomeric Red Fluorescent Protein (mRFP) and Superfolder Green Fluorescent Protein (sfGFP), based on Qi L S, et al. (Cell 152, 5, 1173-1183 (2013)). This screen was utilized to assay gene-specific transcriptional repression mediated by programmable DNA binding of the CasX system). This strain of *E. coli* expresses bright green and red fluorescence under standard culturing conditions or when grown as colonies on agar plates. Under a CRISPRi system, the CasX protein is expressed from an anhydrotetracycline (aTc)-inducible promoter on a plasmid containing a p15A replication origin (plasmid pSTX3; chloramphenicol resistant), and the sgRNA is expressed from a minimal constitutive promoter on a plasmid containing a ColE1 replication origin (pSTX4, non-targeting spacer, or pSTX5, GFP-targeting spacer #1; carbenicillin resistant). When the *E. coli* strain is co-transformed with both plasmids, genes targeted by the spacer in pSTX4 are repressed; in this case GFP repression is observed, the degree to which is dependent on the function of the targeting CasX protein and sgRNA. In this system, RFP fluorescence can serve as a normalizing control. Specifically, RFP fluorescence should be unaltered and independent of functional CasX based CRISPRi activity. CRISPRi activity can be tuned in this system by regulating the expression of the CasX protein; here, all assays used an induction concentration of 20 nM anhydrotetracycline (aTc) final concentration in growth media.

Libraries of sgRNA were constructed to assess the activity of sgRNA variants in complex with three cleavage-inactivating mutations made to the reference CasX protein open reading frame of Planctomycetes, SEQ ID NO: 2, rendering the CasX catalytically dead (dCasX). These three mutations are referred to as D1 (with a D659A substitution), D2 (with a E756A substitution), or D3 (with a D922A substitution). A fourth library, composed of all three mutations in combination is referred to as DDD (D659A; E756A; D922A substitutions).

Libraries of sgRNA were screened for activity using the above CRISPRi system with either D2, D3, or DDD. After co-transformation and recovery, libraries were grown for 8 hours in 2xyt media with appropriate antibiotics and sorted on a Sony MA900 flow cytometry instrument. Each library version was sorted with three different gates (in addition to the naive, unsorted library). Three different sort gates were employed to extract GFP—cells: 10%, 1%, and "F" which represents ~0.1% of cells, ranked by GFP repression. Finally, each sort was done in two technical replicates. Variants of interest were detected using either Sanger sequencing of picked colonies (UC Berkeley Barker Sequencing Facility) or NGS sequencing of miniprepped plasmid (Massachusetts General Hospital CCIB DNA Core Next-Generation Sequencing Service) or NGS sequencing of PCR amplicons, produced with primers that introduced indexing adapters for sequencing on an Illumina platform (see section above). Amplicons were sent for sequencing with Novogene (Beijing, China) for sequencing on an Illumina Hiseq™, with 150 cycle, paired-end reads. Each sorted sample had at least 3 million reads per technical replicate, and at least 25 million reads for the naive samples. The average read count across all samples was 10 million reads.

4) NGS Data Analysis

Paired end reads were trimmed for adapter sequences with cutadapt (version 2.1), merged to form a single read with flash2 (v2.2.00), and aligned to the reference with bowtie2 (v2.3.4.3). The reference was the entire amplicon sequence, which includes ~30 base pairs flanking the *Planctomyces* reference guide scaffold from the plasmid backbone having the sequence:

```
                                       (SEQ ID NO: 3623)
TGACAGCTAGCTCAGTCCTAGGTATAATACTAGTTACTGGCGCTTTTATC

TCATTACTTTGAGAGCCATCACCAGCGACTATGTCGTATGGGTAAAGCGC

TTATTTATCGGAGAGAAATCCGATAAATAAGAAGCATCAAAGCTGGAGTT

GTCCCAATTCTTCTAGAG
```

Variants between the reference and the read were determined from the bowtie2 output. In brief, custom software in python (analyzeDME/bin/bam_to_variants.py) extracted single-base variants from the reference sequence using the cigar string and md string from each alignment. Reads with poor alignment or high error rates were discarded (mapq<20 and estimated error rate >4%; estimated error rate was calculated using per-base phred quality scores). Single-base variants at locations of poor-quality sequencing were discarded (phred score <20). Immediately adjacent single-base variants were merged into one mutation that could span multiple bases. Mutations were labeled for being single substitutions, insertions, or deletions, or other higher-order mutations, or outside the scaffold sequence.

The number of reads that supported each set of mutations was determined. These read counts were normalized for sequencing depth (mean normalization), and read counts from technical replicates were averaged by taking the geometric mean.

Figure 59B:
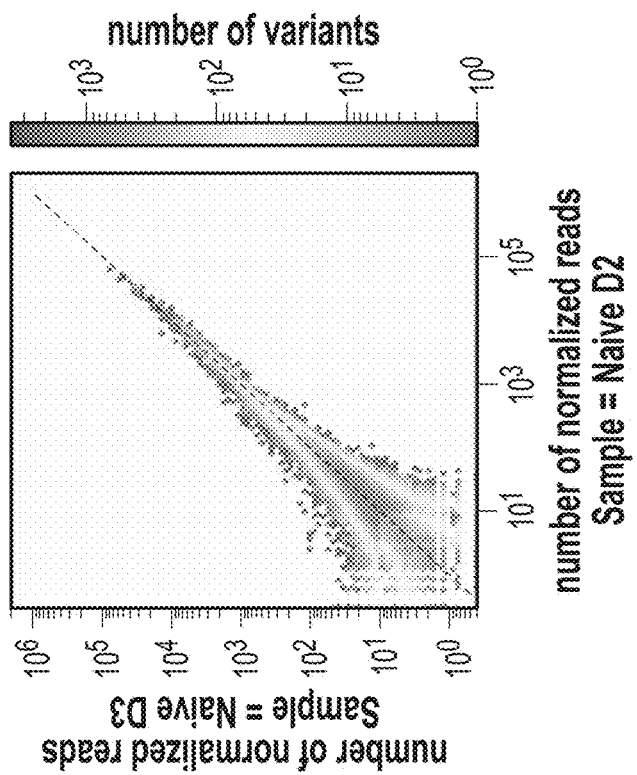
FIGS. 59A-59B show the results of NGS analyses of the libraries of sgRNA, as described in Example 25.
Figure 59A:
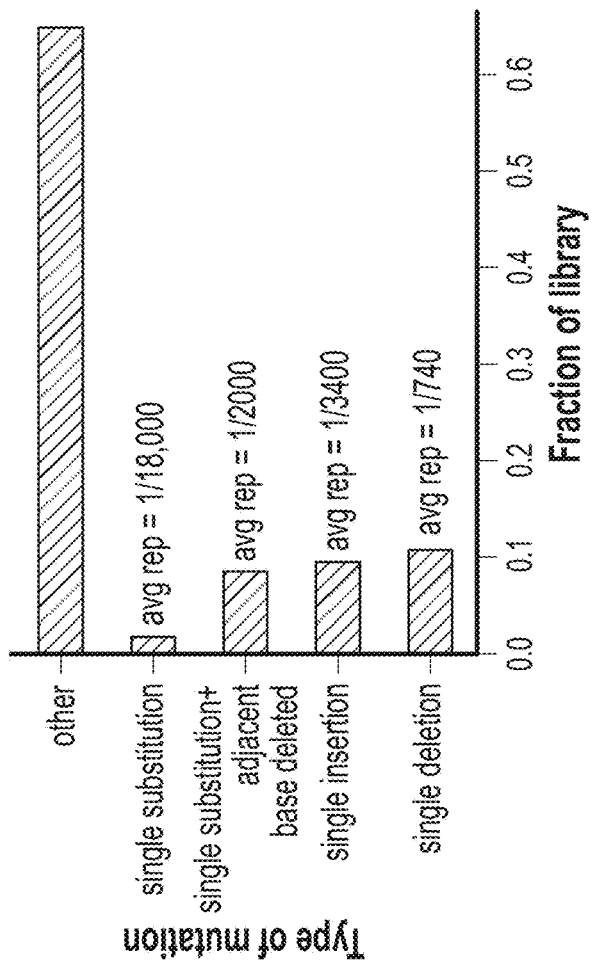

To obtain enrichment values for each scaffold variant, the number of normalized reads for each sorted sample were compared to the average of the normalized read counts for D2 and D3, which were highly correlated (FIG. 59B). The naive DDD sample was not sequenced. To obtain the enrichment for each catalytically dead CasX variant, the log of the enrichment values across the three sort gates were averaged.

Methods for Individual Validation of sgRNA Activity in Human Cell Assays

1) Individual sgRNA Variant Construction

In order to screen variants of interest, individual variants were constructed using standard molecular biology techniques. All mutations were built on the reference CasX (SEQ ID NO: 2) using a staging vector and Gibson cloning. To build single mutations, a universal forward (5'→3') and reverse (3'→5') primer were designed on either end of the encoded protein sequence that had homology to the desired backbone for screening (see Table 23 below). Primers to create the desired mutations were also designed (F primer and its reverse complement) and used with the universal F and R primers for amplification; thus producing two fragments. In order to add multiple mutations, additional primers with overlap were designed and more PCR fragments were produced. For example, to construct a triple mutant, four sets of F/R primers were designed. The resulting PCR fragments were gel extracted. These fragments were subsequently assembled into a screening vector (see Table 23), by digesting the screening vector backbone with the appropriate restriction enzymes and gel extraction. The insert fragments and vector were then assembled using Gibson Assembly® master mix, transformed, and plated using appropriate LB agar+antibiotic. The clones were Sanger sequenced and correct clones were chosen.

Finally, spacer cloning was performed to target the guide RNA to a gene of interest in the appropriate assay or screen. The sequence-verified non-targeting clone was digested with the appropriate Golden Gate enzyme and cleaned using DNA Clean and Concentrator kit (Zymo). The oligos for the spacer of interest were annealed. The annealed spacer was ligated into a digested and cleaned vector using a standard Golden Gate Cloning protocol. The reaction was transformed into Turbo *E. coli* and plated on LB agar+carbenicillin, and allowed to grow overnight at 37° C. Individual colonies were picked the next day, grown for eight hours in 2XYT+carbenicillin at 37° C., and miniprepped. The clones were Sanger sequenced and correct clones were chosen.

TABLE 23 screening vectors and associated primer sequences

| Screening vector | F primer sequence | R primer sequence |
|---|---|---|
| pSTX6 | SAH24: TTCAGGTTGGACCGGTGCCACCATGGCCCCAAA GAAGAAGCGGAAGGTCAGCCAAGAGATCAAGAG AATCAACAAGATCAGA (SEQ ID NO: 3615) | SAH25: TTTTGGACTAGTCACGGCGGGCT TCCAG (SEQ ID NO: 3616) |
| pSTX16 or pSTX34 | oiC539: ATGGCCCCAAAGAAGAAGCGGAAGGTCtctaga CAAG (SEG ID NO: 3617) | oIC540: TACCTTTCTCTTCTTTTTTGGAC TAGTCACGG (SEG ID NO: 3618) |

2) GFP Editing by Plasmid Lipofection of HEK293T Cells

Either doxycycline-inducible GFP (iGFP) reporter HEK293T cells or SOD1-GFP reporter HEK293T cells were seeded at 20-40 k cells/well in a 96 well plate in 100 μl of FB medium and cultured in a 37° C. incubator with 5% $CO_2$. The following day, confluence of seeded cells was checked. Cells were ~75% confluent at time of transfection. Each CasX construct was transfected at 100-500 ng per well using Lipofectamine™ 3000 following the manufacturer's protocol, into 3 wells per construct as replicates. SaCas9 and SpyCas9 targeting the appropriate gene were used as benchmarking controls. For each Cas protein type, a non-targeting plasmid was used as a negative control.

After 24-48 hours of puromycin selection at 0.3-3 μg/ml to select for successfully transfected cells, followed by 1-7 days of recovery in FB medium, GFP fluorescence in transfected cells was analyzed via flow cytometry. In this process, cells were gated for the appropriate forward and side scatter, selected for single cells and then gated for reporter expression (Attune Nxt Flow Cytometer, Thermo Fisher Scientific) to quantify the expression levels of fluorophores. At least 10,000 events were collected for each sample. The data were then used to calculate the percentage of edited cells.

3) GFP Editing by Lentivirus Transduction of HEK293T Cells

Lentivirus products of plasmids encoding CasX proteins, including controls, CasX variants, and/or CasX libraries, were generated in a Lenti-X 293T Cell Line (Takara) following standard molecular biology and tissue culture techniques. Either iGFP HEK293T cells or SOD1-GFP reporter HEK293T cells were transduced using lentivirus based on standard tissue culture techniques. Selection and fluorescence analysis was performed as described above, except the recovery time post-selection was 5-21 days. For Fluorescence-Activated Cell Sorting (FACS), cells were gated as described above on a MA900 instrument (Sony). Genomic DNA was extracted by QuickExtract™ DNA Extraction Solution (Lucigen) or Genomic DNA Clean & Concentrator (Zymo).

Results:

Engineering of sgRNA 1 to 174

Figure 60A:
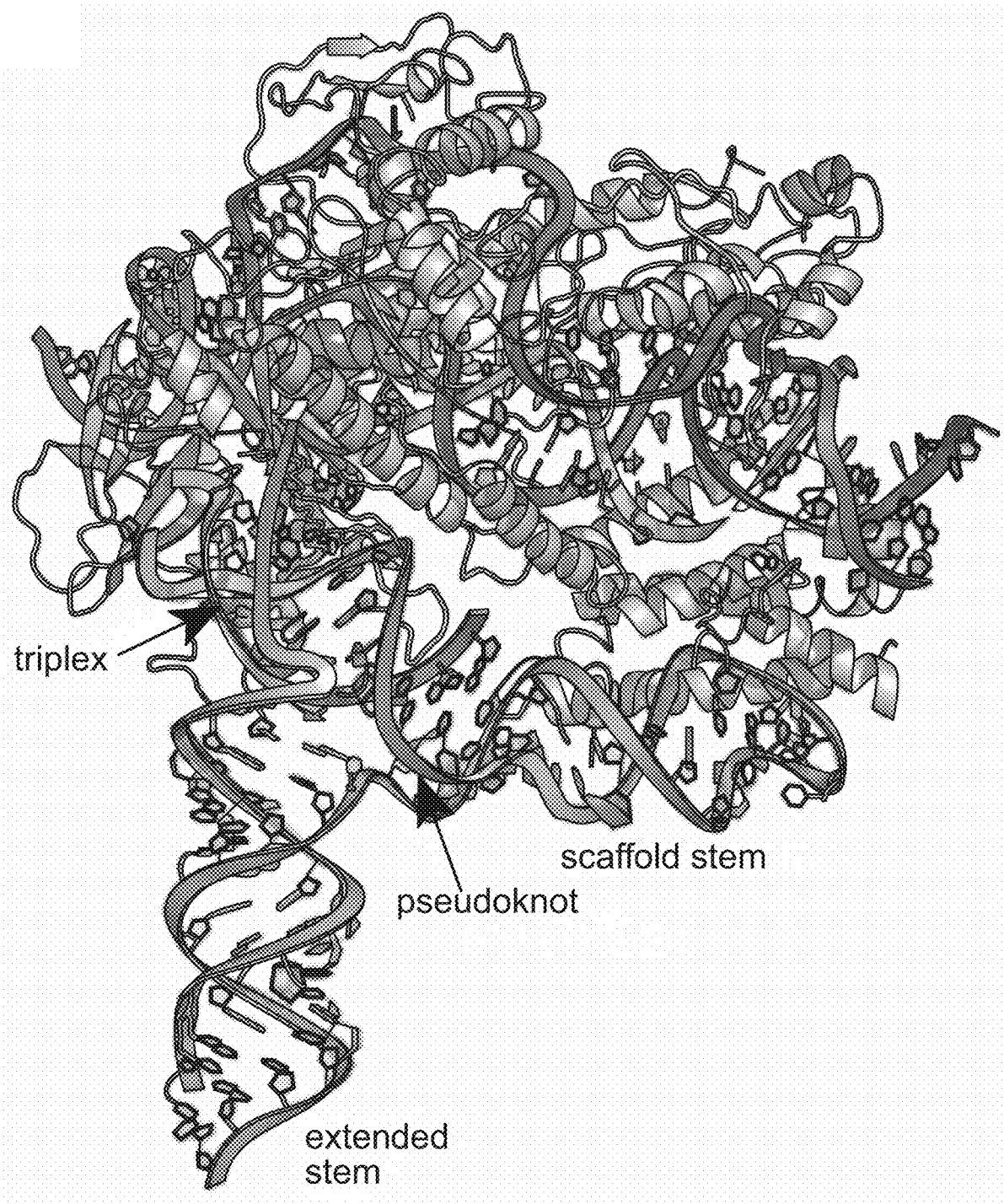
FIGS. 60A-60B show the structure of wild-type CasX and RNA guide (SEQ ID NO:4).
Figure 60B:
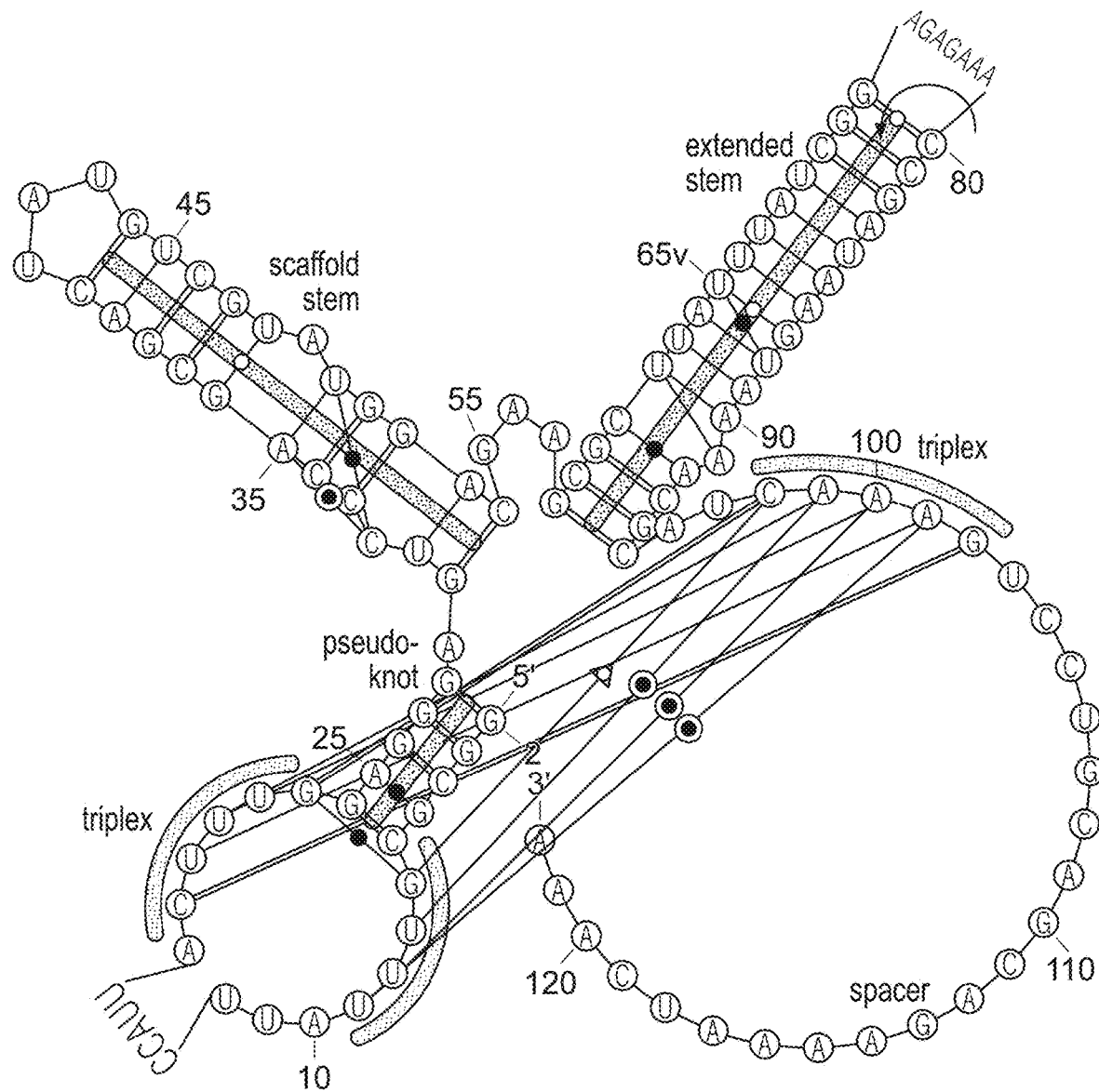
Figure 61A:
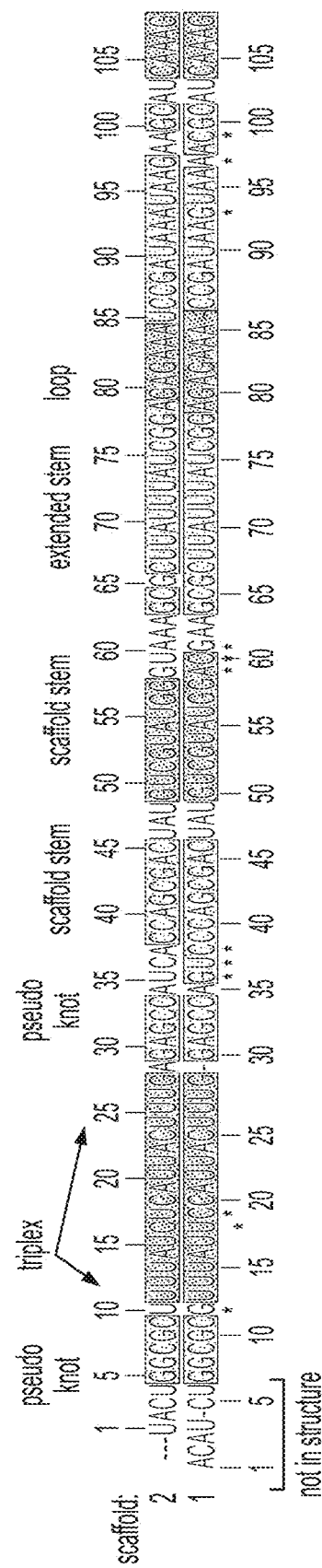
FIGS. 61A-61C depict comparisons between two guide RNA scaffolds.
Figure 61B:
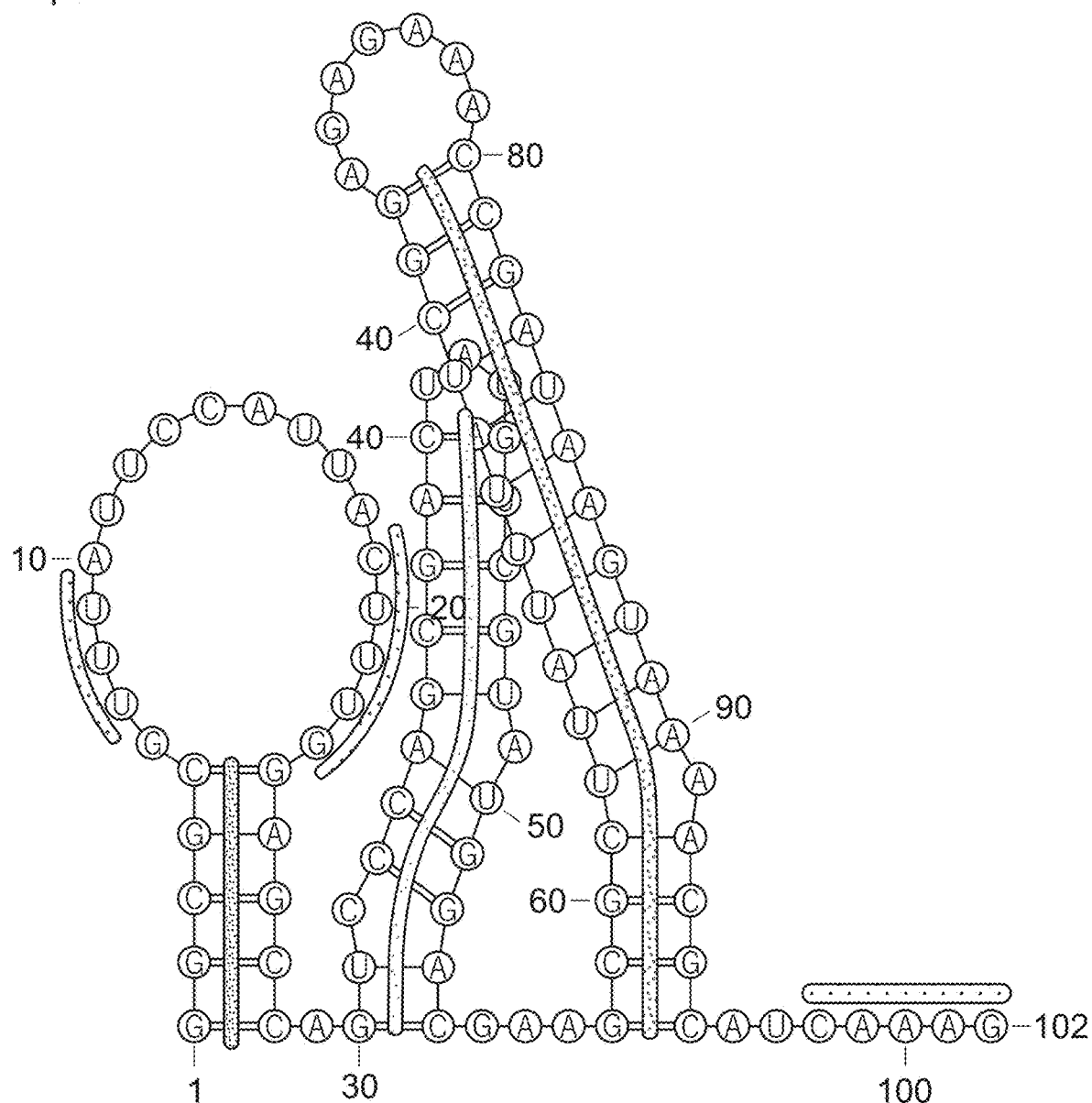
Figure 61C:
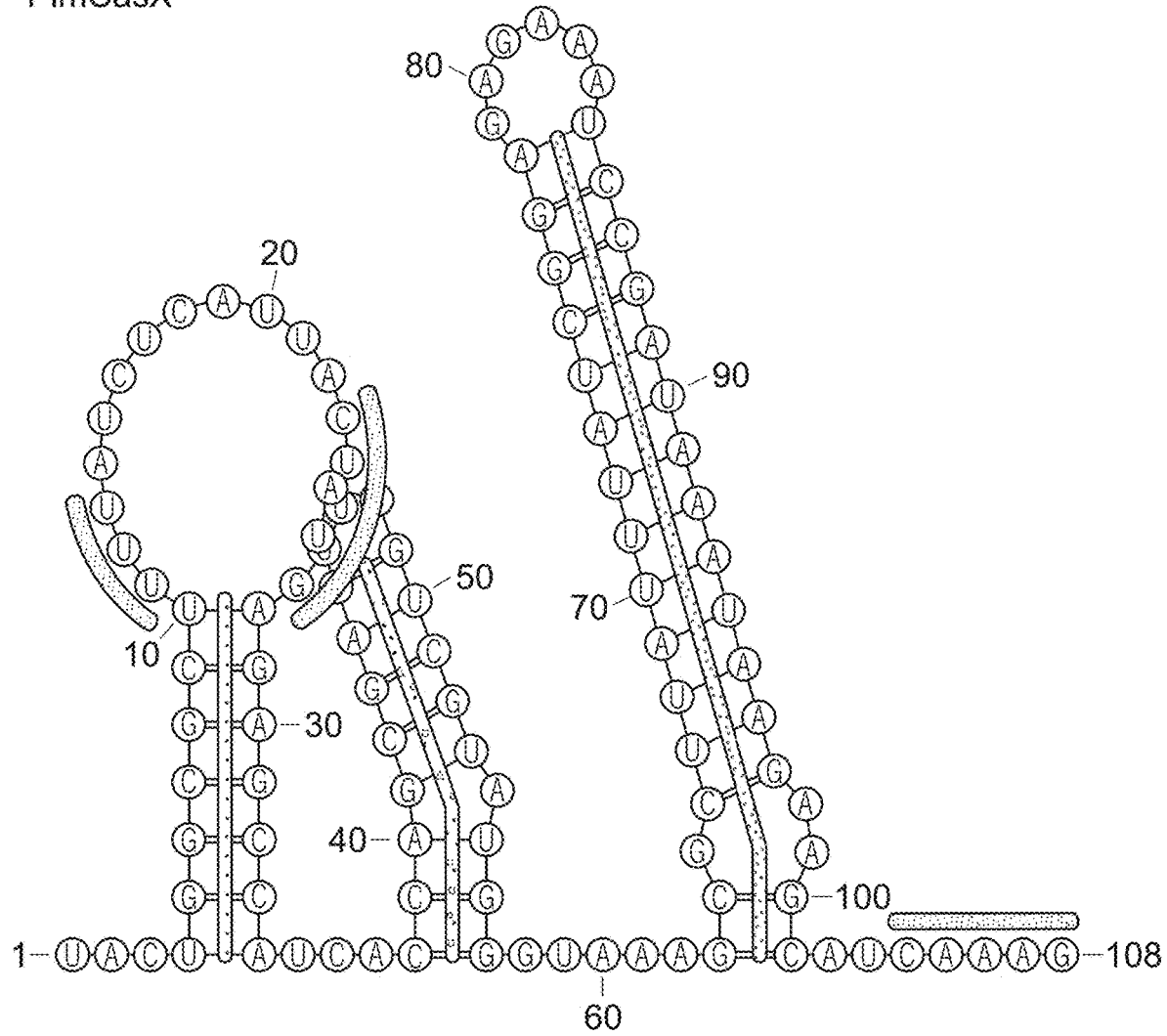

1) sgRNA Derived from Metagenomics of Bacterial Species Improved Function in Human Cells An initial improvement in CasX RNP cleavage activity was found by assessing new metagenomic bacterial sequences for possible CasX guide scaffolds. Prior work demonstrated that Deltaproteobacteria sgRNA (SEQ ID NO: 4) could form a functional RNA-guided nuclease complex with CasX proteins, including the Deltaproteobacteria CasX (SEQ ID NO:1 or Planctomycetes CasX (SEQ ID NO: 2). Structural characterization of this complex allowed identification of structural elements within the sgRNA (FIGS. 60A-60C). However, a sgRNA scaffold from Planctomycetes was never tested. A second tracrRNA was identified from Planctomycetes, which was made into an sgRNA with the same method as was used for Deltaproteobacteria tracrRNA-crRNA (SEQ ID NO: 5) (Liu, J J et al Nature, 566, 218-223 (2019)). These two sgRNA had similar structural elements, based on RNA secondary structure prediction algorithms, including three stem loop structures and possible triplex formation (FIG. 61).

Figure 62:
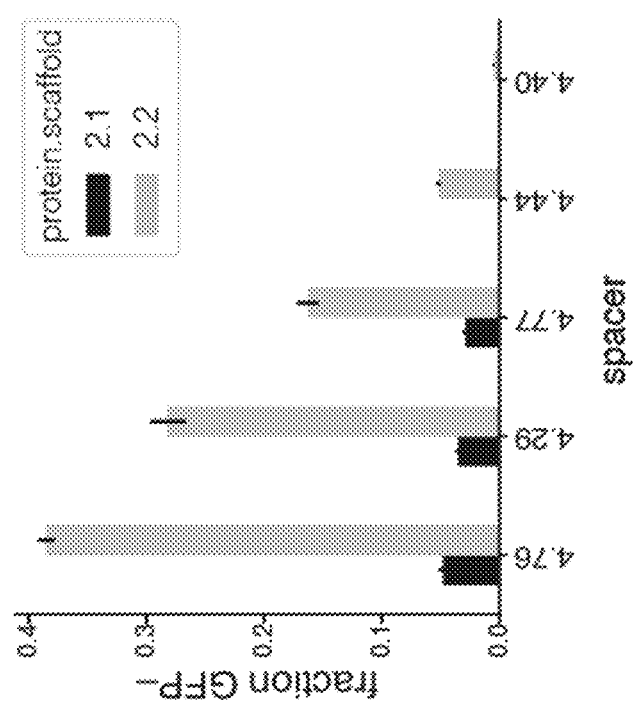
FIG. 62 shows a graph comparing GFP-knockdown capability of scaffold 1 versus scaffold 2 in GFP-lipofection assay, using four different spacers utilizing different PAM sequences, as described in Example 25. The results demonstrate the greater editing imparted by use of the modified scaffold 2 compared to the wild-type scaffold 1; the latter showing no editing with spacers utilizing GTC and CTC PAM sequences.

Characterization the activity of Planctomycetes CasX protein complexed with the Deltaproteobacteria sgRNA (hereafter called RNP 2.1, wherein the CasX protein has the sequence of SEQ ID NO: 2) and Planctomycetes CasX protein complexed with scaffold 2 sgRNA (hereafter called RNP 2.2) showed clear superiority of RNP 2.2 compared to the others in a GFP-lipofection assay (see Methods) (FIG. 62). Thus, this scaffold formed the basis of our molecular engineering and optimization.

2) Improving Activity of CasX RNP Through Comprehensive RNA Scaffold Mutagenesis Screen.

Figure 64:
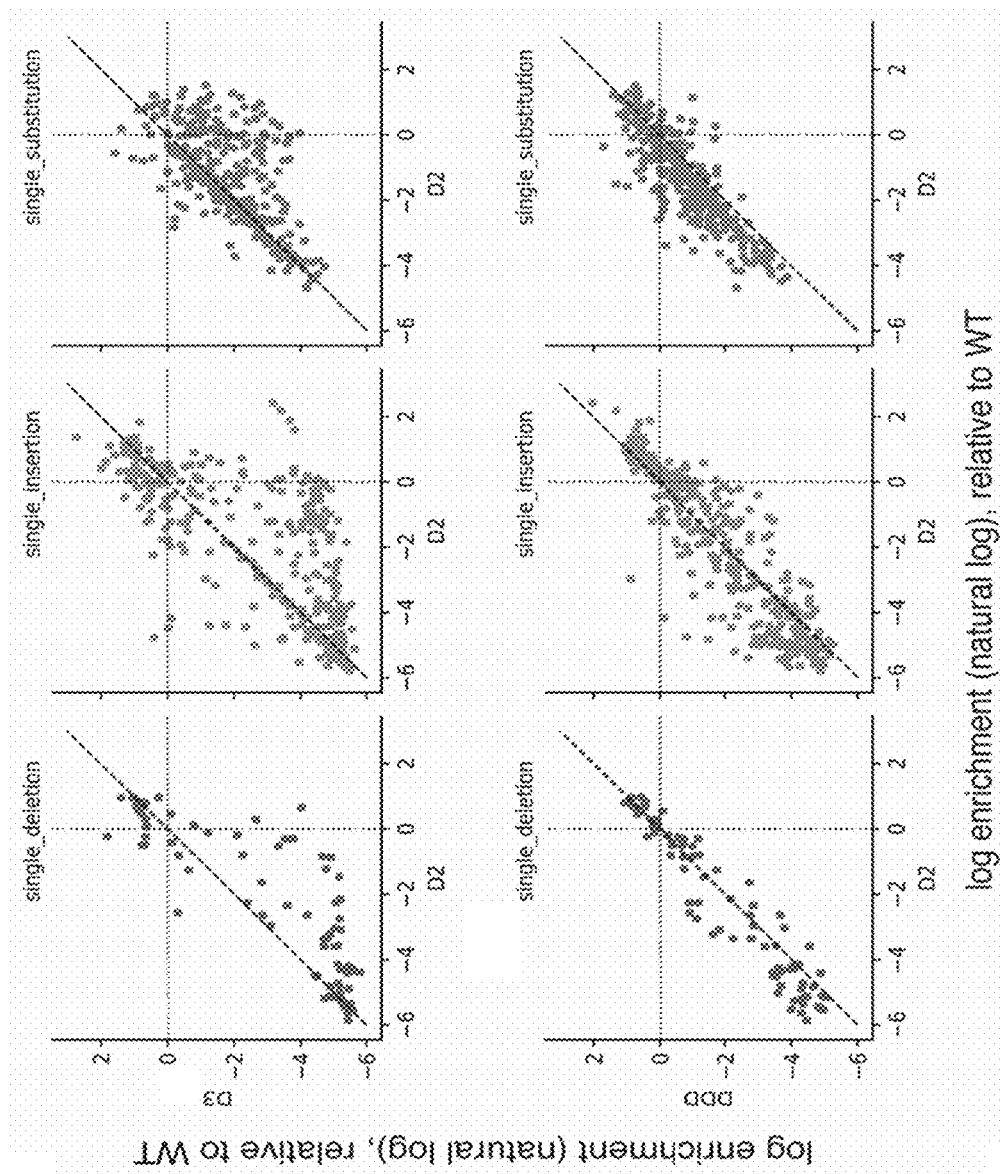
FIG. 64 are scatterplots showing that the enrichment values obtained across different dCasX variants are largely consistent, as described in Example 25. Libraries D2 and DDD have highly correlated enrichment scores, while D3 is more distinct.

To find mutations to the guide RNA scaffold that could improve dsDNA cleavage activity of the CasX RNP, a large diversity of insertions, deletions and substitutions to the gRNA scaffold 2 were generated (see Methods). This diverse library was screened using CRISPRi to determine variants that improved DNA-binding capabilities and ultimately improved cleavage activity in human cells. The library was generated through a process of pooled primer cloning as described in the Materials and Methods. The CRISPRi screen was carried out using three enzymatically-inactive versions of CasX (called D2, D3, and DDD; see Methods). Library variants with improved DNA binding characteristics were identified through a high-throughput sorting and sequencing approach. Scaffold variants from cells with high GFP repression (i.e., low fluorescence) were isolated and identified with next generation sequencing. The representation of each variant in the GFP—pool was compared to its representation in the naive library to form an enrichment score per variant (see Materials and Methods). Enrichment was reproducible across the three catalytically dead-CasX variants (FIG. 64).

Figure 63A:
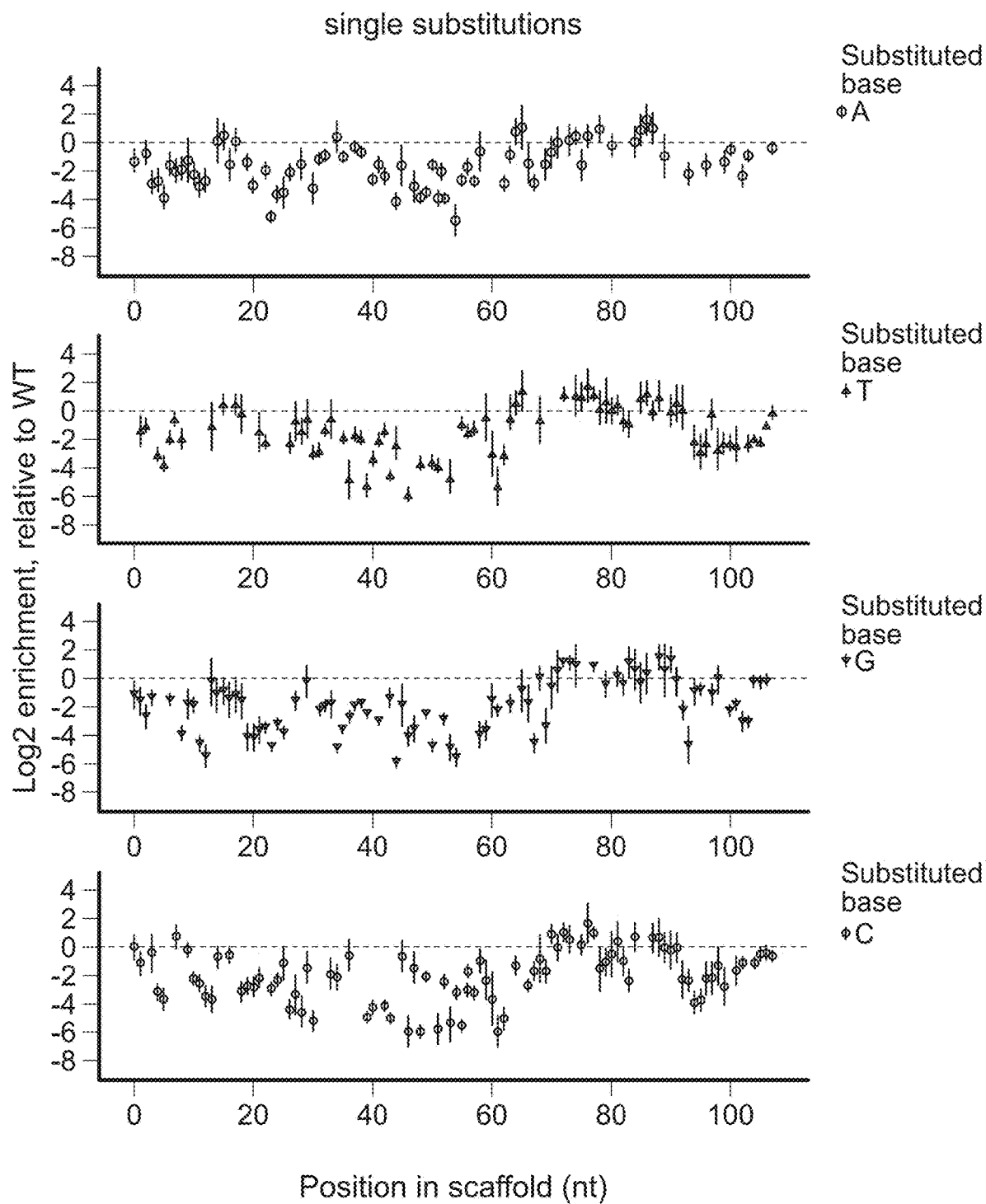
FIGS. 63A-63C shows graphs depicting the enrichment of single variants across the scaffold, revealing mutable regions, as described in Example 25.
Figure 63B:
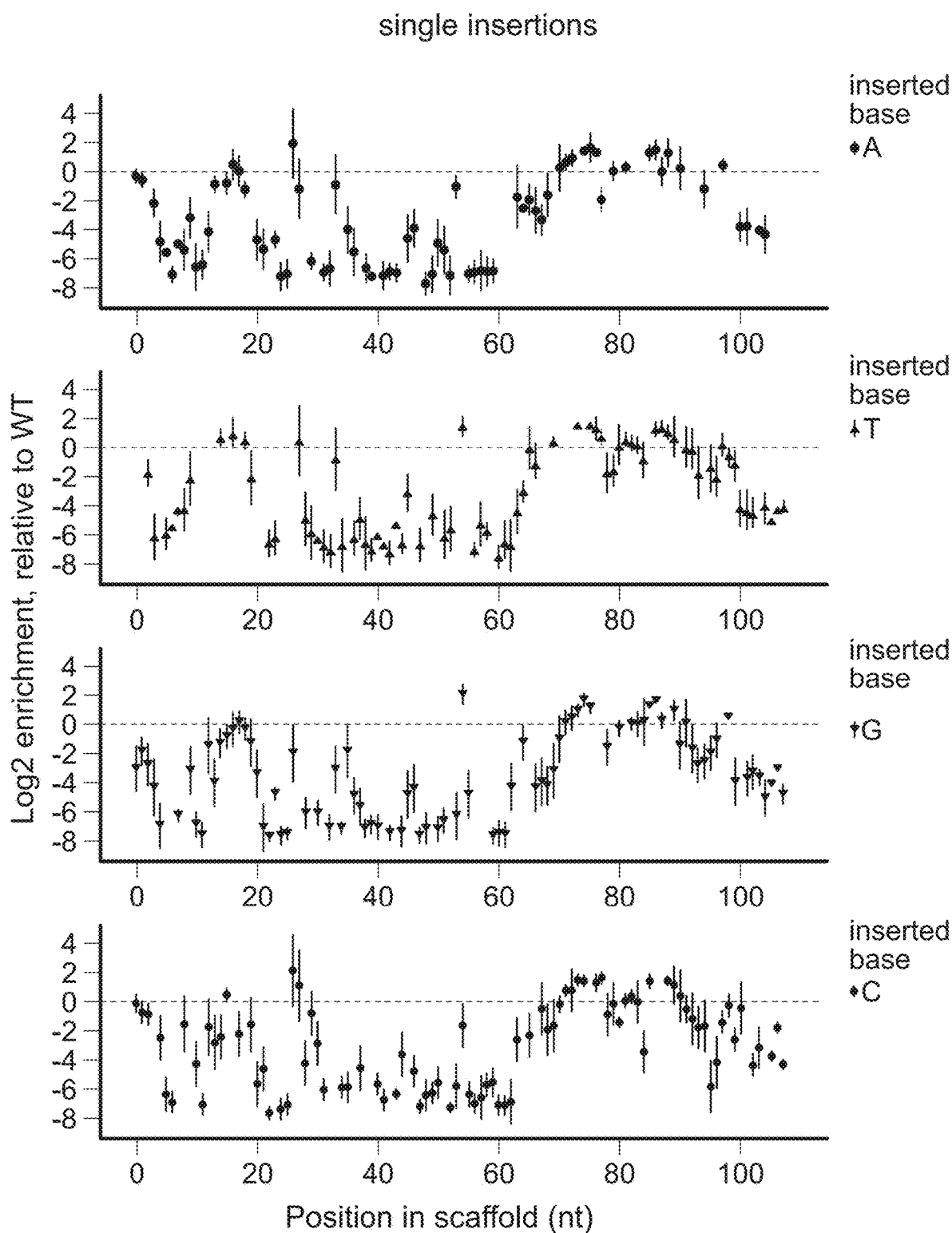

Examining the enrichment scores of all single variants revealed mutable locations within the guide scaffold, especially the extended stem (FIGS. 63A-63C).The top-20 enriched single variants outside of the extended stem are listed in Table 24. In addition to the extended stem, these largely cluster into four regions: position 55 (scaffold stem bubble), positions 15-19 (triplex loop), position 27 (triplex), and in the 5' end of the sequence (positions 1, 2, 4, 8). While the majority of these top-enriched variants were consistently enriched across all three catalytically dead CasX versions, the enrichment at position 27 was variable, with no evident enrichment in the D3 CasX (data not shown).

The enrichment of different structural classes of variants suggested that the RNP activity might be improved by distinct mechanisms. For example, specific mutations within the extended stem were enriched relative to the WT scaffold. Given that this region does not substantially contact the CasX protein (FIG. 60A), we hypothesize that mutating this region may improve the folding stability of the gRNA scaffold, while not affecting any specific protein-binding interaction interfaces. On the other hand, 5' mutations could be associated with increased transcriptional efficiency. In a third mechanism, it was reasoned that mutations to the scaffold stem bubble or triplex could lead to increased stability through direct contacts with the CasX protein, or by affecting allosteric mechanisms with the RNP. These distinct mechanisms to improve RNP binding support that these mutations could be stacked or combined to additively improve activity.

TABLE 24

Top enriched single-variants outside of extended stem.

| Position | Annotation | Reference | Alternate | log2 enrichment | Region |
|---|---|---|---|---|---|
| 55 | insertion | — | G | 2.37466 | scaffold stem bubble |
| 55 | insertion | — | T | 1.93584 | scaffold stem bubble |
| 15 | insertion | — | T | 1.65155 | triplex loop |
| 17 | insertion | — | T | 1.56605 | triplex loop |
| 4 | deletion | T | — | 1.48676 | 5' end |
| 27 | insertion | — | C | 1.26385 | triplex |
| 16 | insertion | — | C | 1.26025 | triplex loop |
| 19 | insertion | — | T | 1.25306 | triplex loop |
| 18 | insertion | — | G | 1.22628 | triplex loop |
| 2 | deletion | A | — | 1.17690 | 5' end |
| 17 | insertion | — | A | 1.16081 | triplex loop |
| 18 | substitution | C | T | 1.10247 | triplex loop |
| 18 | insertion | — | A | 1.04716 | triplex loop |
| 16 | substitution | C | T | 0.97399 | triplex loop |
| 8 | substitution | G | C | 0.95127 | pseudoknot |
| 16 | substitution | C | A | 0.89373 | triplex loop |
| 27 | insertion | — | A | 0.86722 | triplex |
| 1 | substitution | T | C | 0.83183 | 5' end |
| 18 | deletion | C | — | 0.77641 | triplex loop |
| 19 | insertion | — | G | 0.76838 | triplex loop |

3) Assessing RNA Scaffold Mutants in dsDNA Cleavage Assay in Human Cells

The CRISPRi screen is capable of assessing binding capacity in bacterial cells at high throughput. However it does not guarantee higher cleavage activity in human cell assays. We next assessed a large swath of individual scaffold variants for cleavage capacity in human cells using a plasmid lipofection in HEK cells (see Materials and Methods). In this assay, human HEK293T cells containing a stably-integrated GFP gene were transduced with a plasmid (p16) that expresses reference CasX protein (Stx2) (SEQ ID NO: 2) and sgRNA comprising the gRNA scaffold variant and spacers 4.76 (having sequence UGUGGUCGGG-GUAGCGGCUG (SEQ ID NO: 3624) and 4.77 (having sequence UCAAGUCCGCCAUGCCCGAA (SEQ ID NO: 3625)) to target the RNP to knockdown the GFP gene. Percent GFP knockdown was assayed using flow cytometry. Over a hundred scaffold variants were tested in this assay.

Figure 69A:
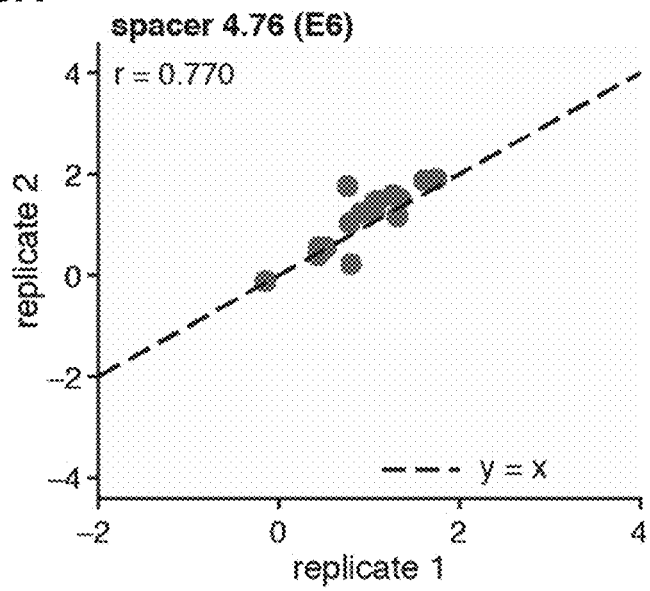
FIGS. 69A-69B shows scatterplots of HEK-iGFP cleavage assay for scaffolds sequences relative to WT scaffold with 2 spacers; 4.76 (FIG. 69A) and 4.77 (FIG. 69B), as described in Example 25.
Figure 69B:
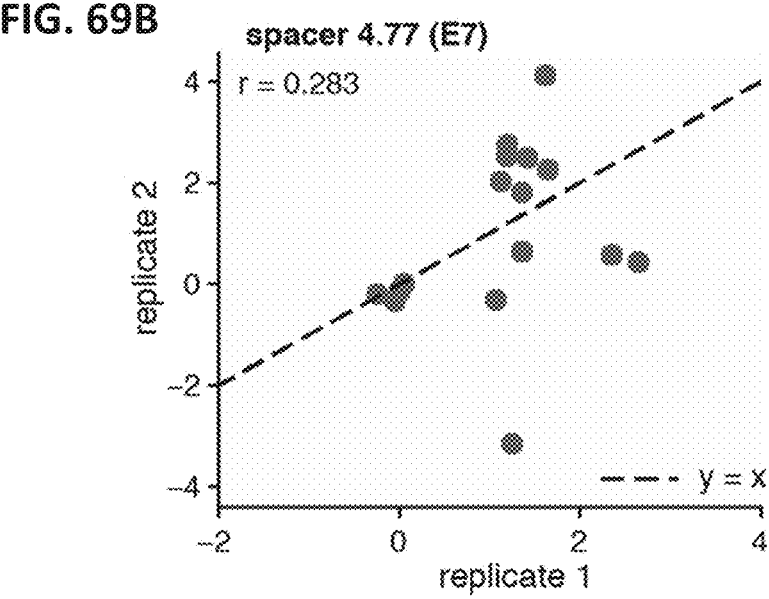
Figure 70:
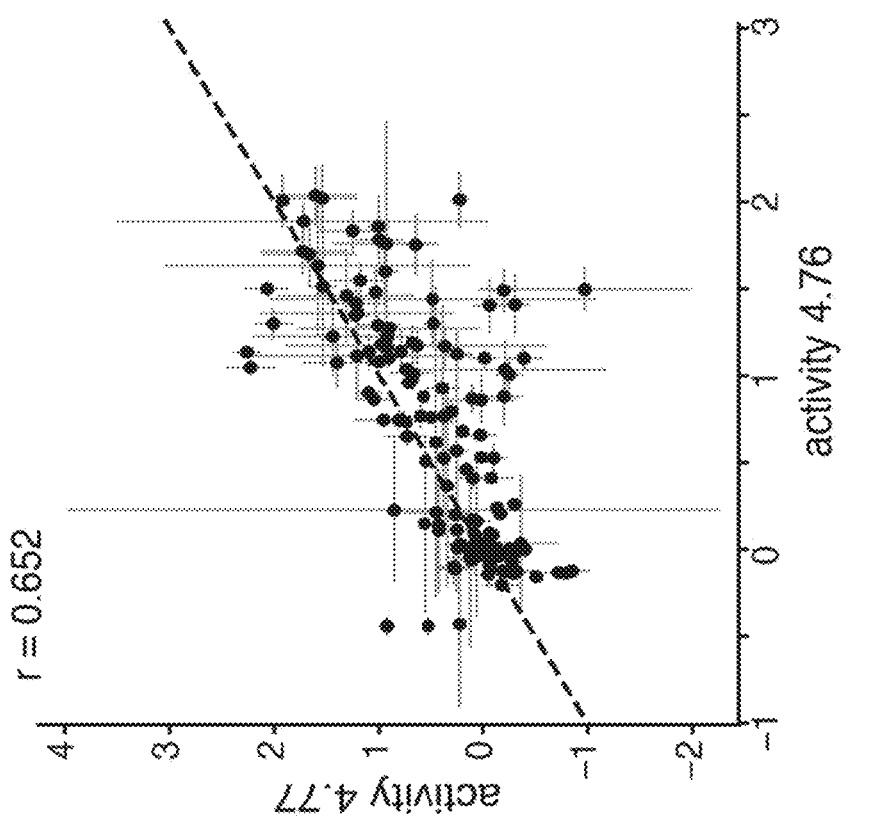
FIG. 70 shows a scatterplot comparing the normalized cleavage activity of several scaffolds relative to WT with 2 spacers (4.76 and 4.77), as described in Example 25. Error bars combine internal measurement error (SD) and inter-experimental measurement error (SD across replicate experiments for those variants tested more than once), in quadrature.

The assay resulted in largely reproducible values across different assay dates for spacer 4.76, while exhibiting more variability for spacer 4.77 (FIG. 69). Spacer 4.77 was generally less active for the wild-type RNP complex, and the lower overall signal may have contributed to this increased variability. Comparing the cleavage activity across the two spacers showed generally correlated results (r=0.652; FIG. 70). Because of the increased noise in spacer 4.77 measurements, the reported cleavage activity per scaffold was taken as the weighted average between the measurements on each scaffold, with the weights equal to the inverse squared error. This weighting effectively down-weights the contribution from high-error measurements.

Figure 63C:
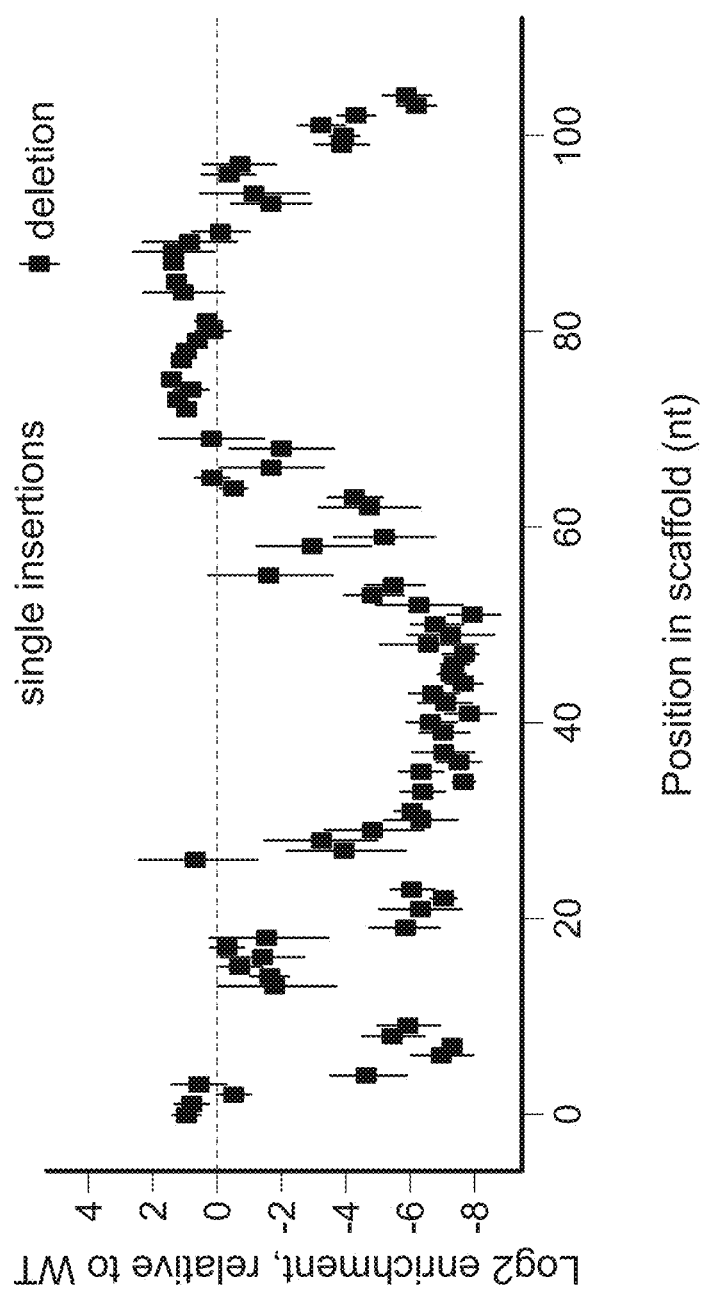
Figure 71:
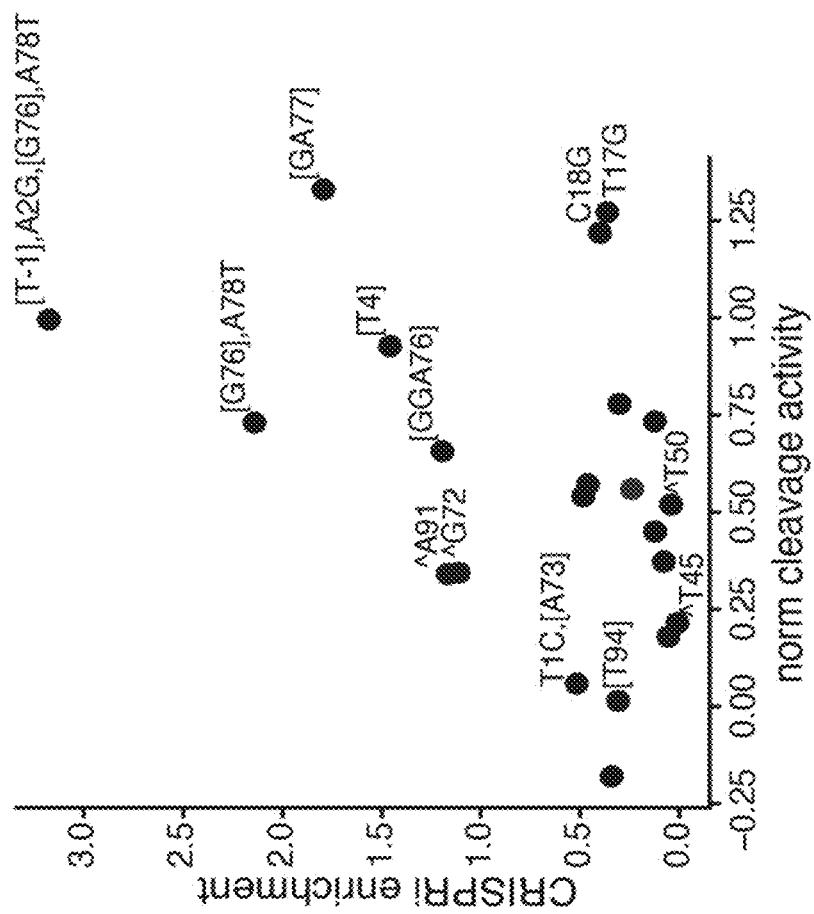
FIG. 71 shows a scatterplot comparing the normalized cleavage activity of multiple scaffolds relative to WT in the HEK-iGFP cleavage assay to the enrichments obtained from the CRISPRi comprehensive screen, as described in Example 25. Generally, scaffold mutations with high enrichment (>1.5) have cleavage activity comparable to or greater than WT. Two variants have high cleavage activity with low enrichment scores (C18G and T17G); interestingly, these substitutions are at the same position as several highly enriched insertions (FIGS. 63A-63C). Labels indicate the mutations for a subset of the comparisons.

A subset of sequences was tested in both the HEK-iGFP assay and the CRISPRi assay. Comparing the CRISPRi enrichment score to the GFP cleavage activity showed that highly-enriched variants had cleavage activity at or exceeding the wildtype RNP (FIG. 63C). Two variants had high cleavage activity with low enrichment scores (C18G and T17G); interestingly, these substitutions are at the same position as several highly-enriched insertions (FIG. 71).

Examining all scaffolds tested in the HEK-iGFP assay revealed certain features that consistently improved cleavage activity. We found that the extended stem could often be completely swapped out for a different stem, with either improved or equivalent activity (e.g., compare scaffolds of SEQ ID NO: 2101-2105, 2111, 2113, 2115; all of which have replaced the extended stem, with increased activity relative to the reference, as seen in Table 5). We specifically focused on two stems with different origins: a truncated version of the wildtype stem, with the loop sequence replaced by the highly stable UUCG tetraloop (stem 42). The other (stem 46) was derived from Uvsx bacteriophage T4 mRNA, which in its biological context is important for regulation of reverse transcription of the bacteriophage genome (Tuerk et al. Proc Natl Acad Sci USA. 85(5):1364 (1988)). The top-performing gRNA scaffolds all had one of these two extended stem versions (e.g., SEQ ID NOS: 2160 and 2161).

Appending ribozymes to the 3' end often resulted in functional scaffolds (e.g., see SEQ ID NO: 2182 with equivalent activity to the WT guide in this assay {Table 5}). On the other hand, adding to the 5' end generally hurt cleavage activity. The best-performing 5' ribozyme construct (SEQ ID NO: 2208) had cleavage activity <40% of the WT guide in the assay.

Certain single-point mutations were generally good, or at least not harmful, including T10C, which was designed to increase transcriptional efficiency in human cells by removing the four consecutive T's at the 5' start of the scaffold (Kiyama and Oishi. Nucleic Acids Res., 24:4577 (1996)). C18G was another helpful mutation, which was obtained from individual colony picking from the CRISPRi screen. The insertion of C at position 27 was highly-enriched in two out of the three dCasX versions of the CRISPRi screen. However, it did not appear to help cleavage activity. Finally, insertion at position 55 within the RNA bubble substantially improved cleavage activity (i.e., compare SEQ ID NO: 2236, with a ˆG55 insertion to SEQ ID NO: 2106 in Table 5).

4) Further Stacking of Variants in Higher-Stringency Cleavage Assays

Figure 65:
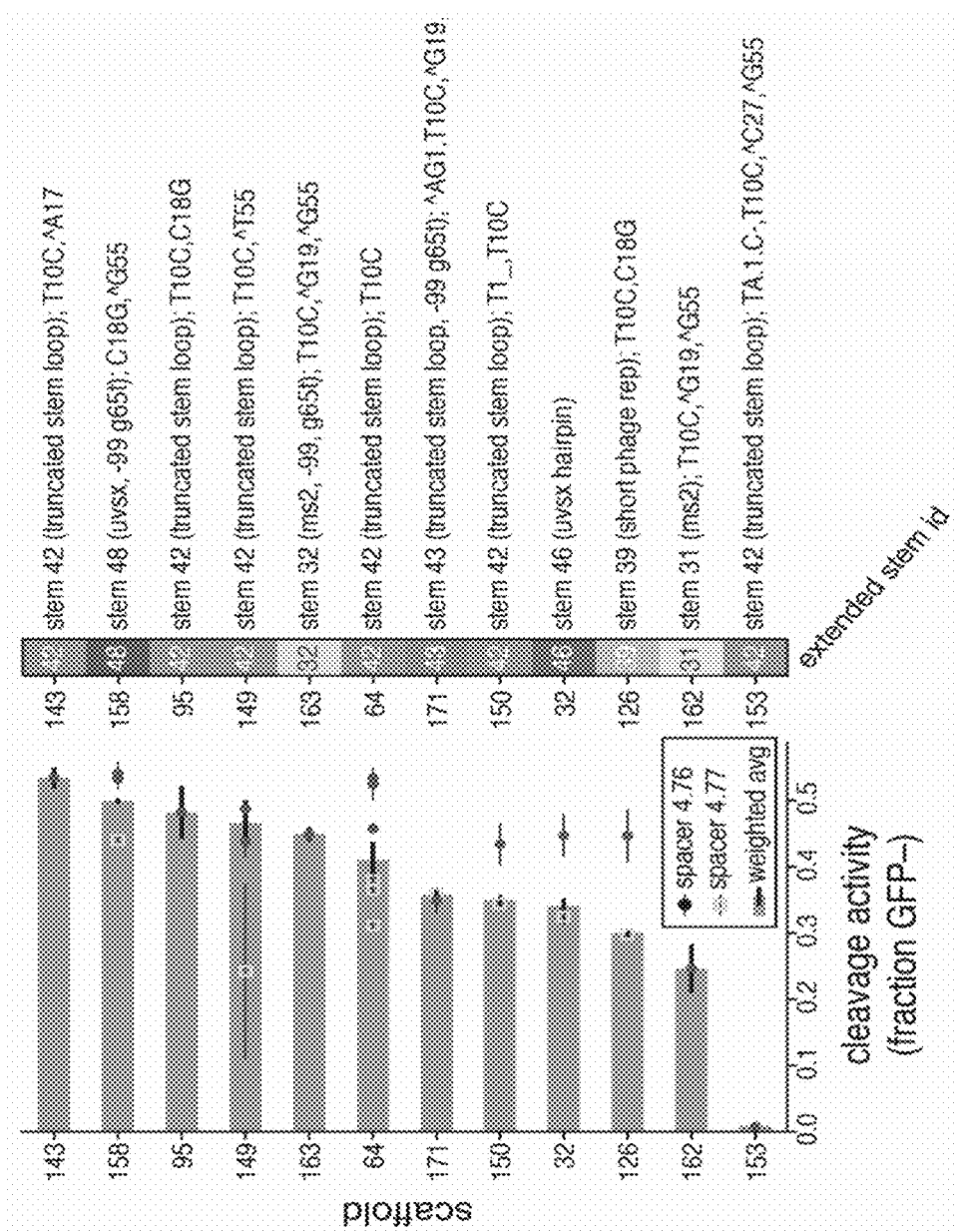
FIG. 65 shows a bar graph of cleavage activity of several scaffold variants in a more stringent lipofection assay at the SOD1-GFP locus, as described in Example 25.

Scaffold mutations that proved beneficial were stacked together to form a set of new variants that were tested under more stringent criteria: a plasmid lipofection assay in human HEK-293t cells with the GFP gene knocked into the SOD1 allele, which we observed was generally harder to knock down. Of this batch of variants, guide scaffold 158 was identified as a top-performer (FIG. 65). This scaffold had a modified extended stem (Uvsx), with additional mutations to fully base pair the extended stem ([A99] and G65U). It also contained mutations in the triplex loop (C18G) and in the scaffold stem bubble (^G55).

Figure 66:
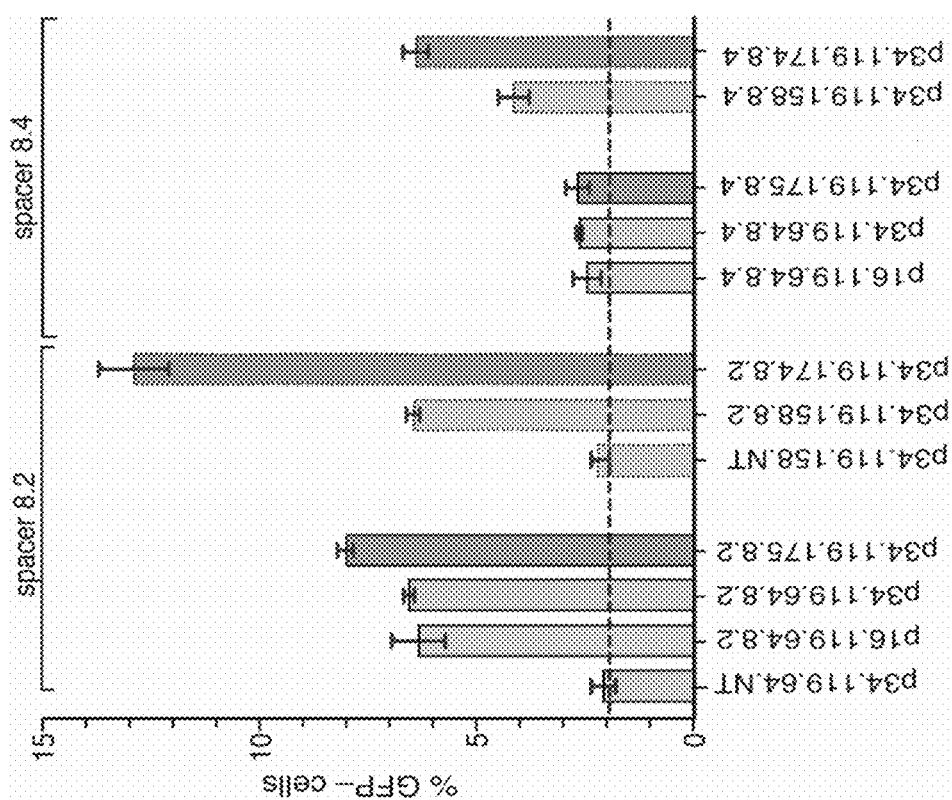
FIG. 66 shows a bar graph of cleavage activity for several scaffold variants using two different spacers; 8.2 and 8.4 that target SOD1-GFP locus (and a non-targeting spacer NT), with low-MOI lentiviral transduction using a p34 plasmid backbone, as described in Example 25.
Figure 67:
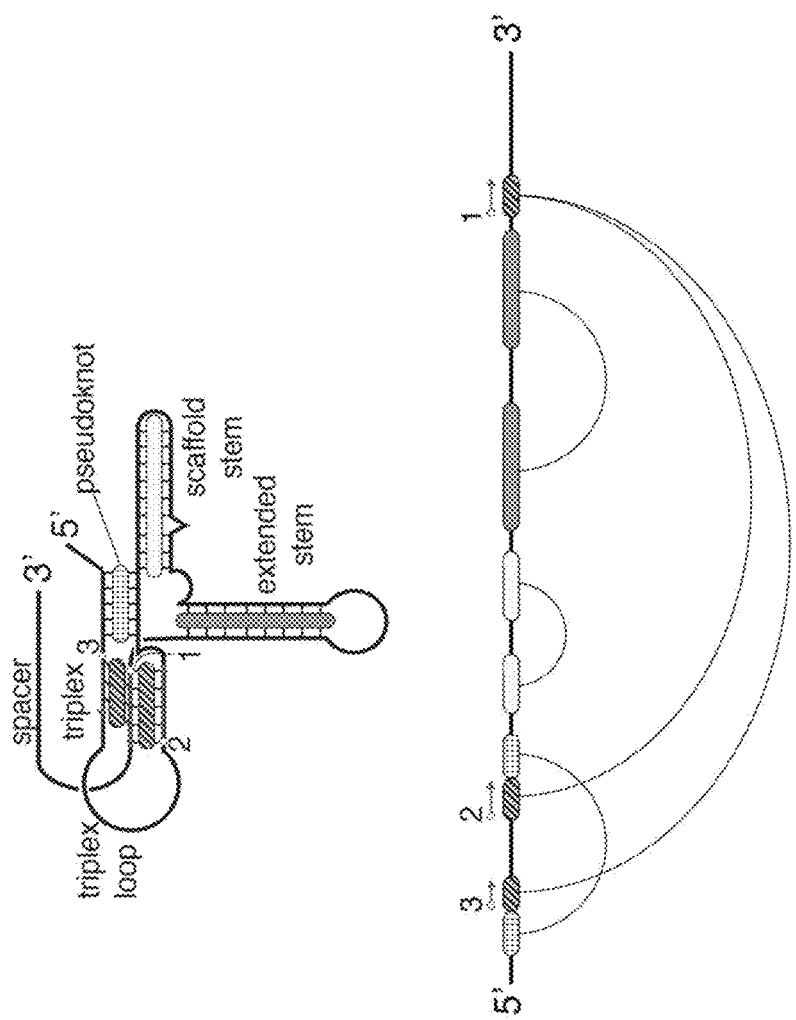
FIG. 67 is a schematic showing the secondary structure of single guide 174 on top and the linear structure on the bottom, with lines joining those segments associating by base-pairing or other non-covalent interactions. The scaffold stem (white, no fill) (and loop) and the extended stem (grey, no fill) (and loop) are adjacent from 5' to 3' in the sequence. However, the pseudoknot and extended stems are formed from strands that have intervening regions in the sequence. The triplex is formed, in the case of single guide 174, comprising nucleotides 5'-CUUUG'-3' AND 5'-CAAAG-3' that form a base-paired duplex and nucleotides 5'-UUU-3' that associates with the 5'-AAA-3' to form the triplex region.

In a second validation of improved DNA editing capacity, sgRNAs were delivered to cells with low-MOI lentiviral transduction, and with distinct targeting sequences to the SOD1 gene (see Methods); spacers were 8.2 (having sequence AUGUUCAUGAGUUUGGAGAU (SEQ ID NO: 3626)), and 8.4 (having sequence UCGCCAUAACUCGC-UAGGCC (SEQ ID NO: 3627)) (results shown in FIG. 66). Additionally, 5' truncations of the initial GT of guide scaffolds 158 and 64 were deleted (forming scaffolds 174 and 175 respectively). This assay showed dominance of guide scaffold 174: the variant derived from guide scaffold 158 with 2 bases truncated from the 5' end (FIG. 66). A schematic of the secondary structure of scaffold 174 is shown in FIG. 67.

Figure 68A:
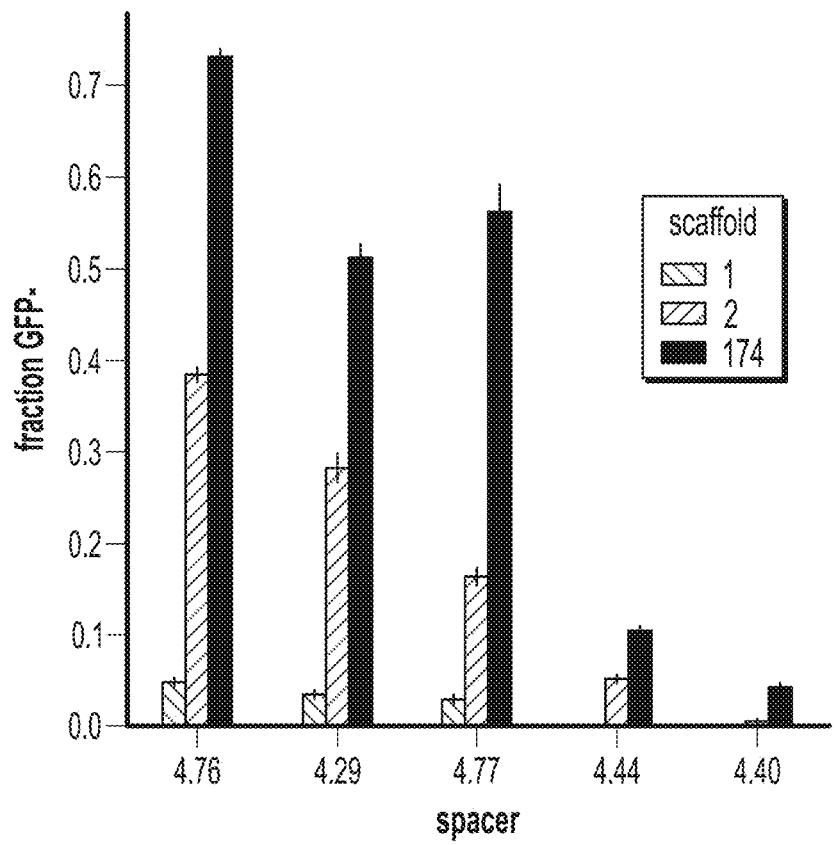
FIGS. 68A and 68B show comparisons between the highly-evolved single guide 174 and the scaffolds 1 and 2 that served as the starting points for the DME procedures described in Example 25.
Figure 68B:
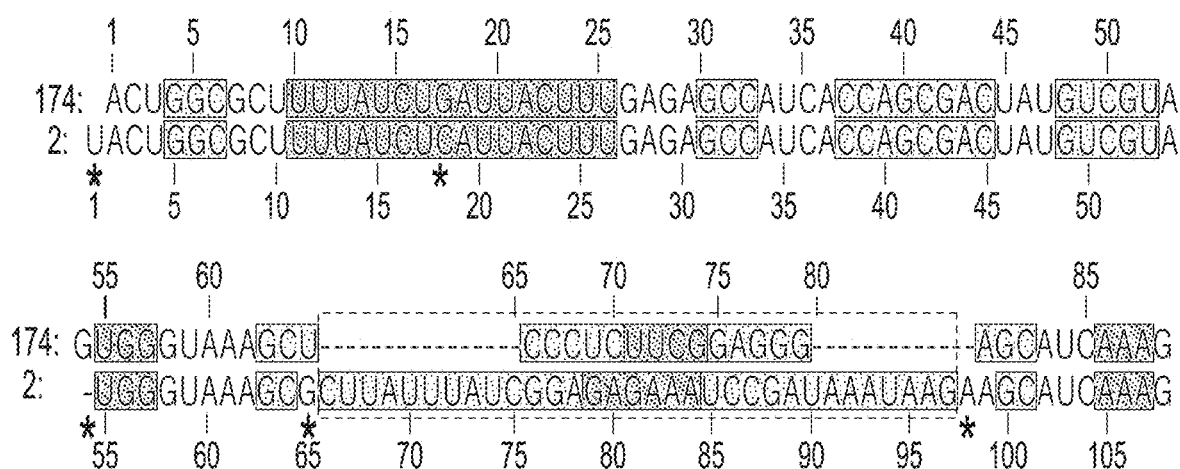

In sum, our improved guide scaffold 174 showed marked improvement over our starting reference guide scaffold (scaffold 1 from Deltaproteobacteria, SEQ ID NO:4), and substantial improvement over scaffold 2 (SEQ ID NO: 5) (FIG. 68). This scaffold contained a swapped extended stem (replacing 32 bases with 14 bases), additional mutations in the extended stem ([A99] and G65U), a mutation in the triplex loop (C18G), and in the scaffold stem bubble (^G55) (where all the numbering refers to the scaffold 2). Finally, the initial T was deleted from scaffold 2, as well as the G that had been added to the 5' end in order to enhance transcriptional efficiency. The substantial improvements seen with guide scaffold 174 came collectively from the indicated mutations.

Example 26: Editing of RHO in ARPE19 RHO-GFP Cells

The purpose of the experiment was to demonstrate the ability of CasX to edit the RHO locus using the CasX variants 438, 488 and 491, guide 174 variant, and spacers targeting Exon 1 of the RHO gene. Spacers were chosen based on PAM availability in the locus without prior knowledge of potential activity.

To facilitate assessment of editing outcomes, an ARPE19 RHO-GFP reporter cell line was first generated by knocking into ARPE19 cells a transgene cassette that constitutively expresses Exon 1 of the human RHO gene linked to GFP. The modified cells were expanded by serial passage every 3-5 days and maintained in Fibroblast (FB) medium, consisting of Dulbecco's Modified Eagle Medium (DMEM; Corning Cellgro, #10-013-CV) supplemented with 10% fetal bovine serum (FBS; Seradigm, #1500-500), and 100 Units/mL penicillin and 100 mg/mL streptomycin (100×-Pen-Strep; GIBCO #15140-122), and can additionally include sodium pyruvate (100×, Thermofisher #11360070), non-essential amino acids (100× Thermofisher #11140050), HEPES buffer (100× Thermofisher #15630080), and 2-mercaptoethanol (1000× Thermofisher #21985023). The cells were incubated at 37° C. and 5% CO2. After 1-2 weeks, GFP+ cells were bulk sorted into FB medium. The reporter lines were expanded by serial passage every 3-5 days and maintained in FB medium in an incubator at 37° C. and 5% CO2. Reporter clones were generated by a limiting dilution method. The clonal lines were characterized via flow cytometry, genomic sequencing, and functional modification of the RHO locus using a previously validated RHO targeting CasX molecule. The optimal reporter lines were identified as ones that i) had a single copy of GFP correctly integrated per cell, ii) maintained doubling times equivalent to unmodified cells, and iii) resulted in reduction in GFP fluorescence upon disruption of the RHO gene when assayed using the methods described below.

ARPE19 RHO-GFP reporter cells, constructed using cell line generation methods described above, were used for this experiment. Cells were seeded at 20-40 k cells/well in a 96 well plate in 100 µL of FB medium and cultured in a 37° C. incubator with 5% CO2. The following day, lentiviral vectors packaging each CasX and guide construct (e.g., see Table 25 for sequences) were used to transduce cells at a high multiplicity of infection (MOI), using 3 wells per construct as replicates. A lentivirus packaging a non-targeting construct was used as a negative control. Cells were selected for successful transduction with puromycin at 0.3-3 µg/ml for 24-48 hours followed by recovery in FB medium. Edited cells were analyzed by flow cytometry 14 days after transduction. Briefly, cells were sequentially gated for live cells, single cells, and fraction of GFP-negative cells.

Figure 72:
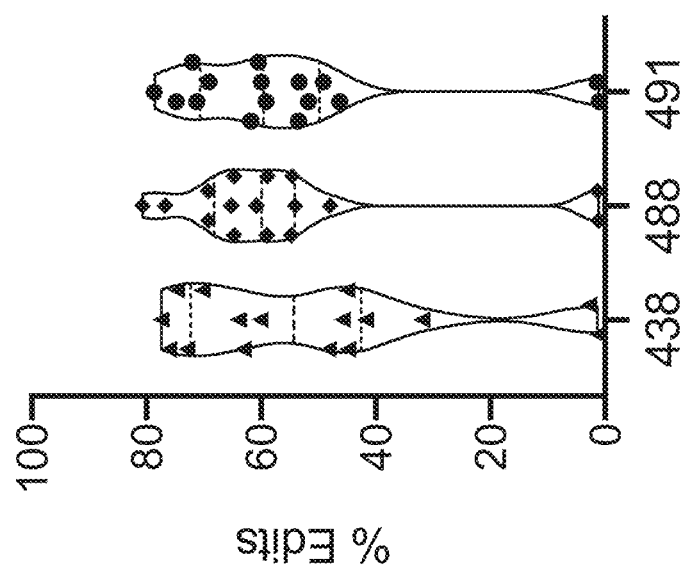
FIG. 72 shows the results of flow cytometry analysis of Cas-mediated editing at the RHO locus in APRE19 RHO-GFP cells 14 days post-transfection for the CasX variant constructs 438, 499 and 491, as described in Example 26. The points are the results of individual samples and the light dashed lines are upper and lower quartiles.

Results: The graph in FIG. 72 shows the results of flow cytometry analysis of Cas-mediated editing at the RHO locus in APRE19 RHO-GFP cells 14 days post-transfection. Eighteen different spacers (indicated by the individual data points) targeting the RHO Exon 1 locus were used for each of the different CasX variants (438, 488, and 491) used in this experiment. Each data point is an average measurement of 3 replicates for an individual spacer. The median values for the constructs were: 438 (48.4); 488 (59.0) and 491 (56.4), indicating that under the conditions of the assay, each of the CasX variants with appropriate guides were able to specifically edit in APRE19 RHO-GFP reporter cells at a high level while the construct with a non-targeting spacer resulted in no editing (data not shown).

TABLE 25

Guide encoding sequences

| Spacer | SPACER SEQUENCE (SEQ ID NO) | 174 GUIDE + SPACER SEQUENCE (SEQ ID NO) |
|---|---|---|
| 11.13 | 3628 | 3646 |
| 11.14 | 3629 | 3647 |
| 11.15 | 3630 | 3648 |
| 11.16 | 3631 | 3649 |
| 11.17 | 3632 | 3650 |
| 11.18 | 3633 | 3651 |
| 11.19 | 3634 | 3657 |
| 11.20 | 3635 | 3653 |
| 11.21 | 3636 | 3654 |
| 11.22 | 3637 | 3655 |
| 11.23 | 3638 | 3656 |
| 11.24 | 3639 | 3657 |
| 11.25 | 3640 | 3658 |
| 11.26 | 3641 | 3659 |
| 11.27 | 3642 | 3660 |
| 11.28 | 3643 | 3661 |
| 11.29 | 3644 | 3662 |
| 11.1 | 3645 | 3663 |

Example 27. Design of Improved Guides Based on Predicted Secondary Structure Stability Methods A computational method was employed to predict the relative stability of the 'target' secondary structure, compared to alternative, non-functional secondary structures.

First, the 'target' secondary structure of the gRNA was determined by extracting base-pairs formed within the RNA in the CryoEM structure for CasX 1.1. For prediction of RNA secondary structure, the program RNAfold was used (version 2.4.14). The 'target' secondary structure was converted to a 'constraint string' that enforces bases to be paired with other bases, or to be unpaired. Because the triplex is unable to be modeled in RNAfold, the bases involved in the triplex are required to be unpaired in the constraint string, whereas all bases within other stems (pseudoknot, scaffold, and extended stems) were required to be appropriately paired. For guide scaffolds 2 (SEQ ID NO:5), 174 (SEQ ID NO:2238), and 175 (SEQ ID NO:2239), this constraint string was constructed based on sequence alignment between the scaffold and scaffold 1 (SEQ ID NO:4) outside of the extended stem, which can have minimal sequence identity. Within the extended stem, bases were assumed to be paired according to the predicted secondary structure for the isolated extended stem sequence. See Table 26 for a subset of sequences and their constraint strings.

Results

A series of new scaffolds was designed to improve scaffold activity based on existing data and new hypotheses. Each new scaffold comprised a set of mutations that, in combination, were predicted to enable higher activity of dsDNA cleavage. These mutations fell into the following categories: First, mutations in the 5' unstructured region of the scaffold were predicted to increase transcription efficiency or otherwise improve activity of the scaffold. Most commonly, scaffolds had the 5' "GU" nucleotides deleted (scaffolds 181-220: SEQ ID NOS: 2242-2280). The "U" is the first nucleotide (U1) in the reference sequence SEQ ID NO:5. The G was prepended to increase transcription efficiency by U6 polymerase. However, removal of these two nucleotides was shown, surprisingly, to increase activity (FIG. 66). Additional mutations at the 5' end include (a) combining the GU deletion with A2G, such that the first transcribed base is the G at position 2 in the reference scaffold (scaffold 199: SEQ ID NO:2259); (b) deleting only U1 and keeping the prepended G (scaffold 200: SEQ ID NO:2260); and (c) deleting the U at position 4, which is

TABLE 26

Constraint strings to represent the 'target secondary structure' in RNAfold algorithm.

| Name | Constraint string |
|---|---|
| Scaffold 1 (w/5' truncation as in CryoEM structure) | (((((.xxx..........xxxxx))))).((.(((((((...)))))..))))...((((((((((((.......))))))))))).))))..xxxxx |
| Scaffold 2 | ....(((((.xxx..........xxxxx.))))....((((((((...))))).))).....(.(((((((((((.......))))))))))))..)..xxxxx |
| Scaffold 174 | ...(((((.xxx..........xxxxx.))))....((((((((...)))))..))).....((((((.....))))))))..xxxxx |
| Scaffold 175 | ...(((((.xxx..........xxxxx.))))....((((((((...)))))..))).....(.((((((((....))))))))..))..xxxxx |

Secondary structure stability of the ensemble of structures that satisfy the constraint was obtained, using the command: 'RNAfold -p0 --noPS -C' And taking the 'free energy of ensemble' in kcal/mol ($\Delta G\_constraint$). The prediction was repeated without the constraint to get the secondary structure stability of the entire ensemble that includes both the target and alternative structures, using the command: 'RNAfold -p0 --noPS' and taking the 'free energy of ensemble' in kcal/mol ($\Delta G\_all$).

The relative stability of the target structure to alternate structures was quantified as the difference between these two $\Delta G$ values: $\Delta\Delta G = \Delta G\_constraint - \Delta G\_all$. A sequence with a large value for $\Delta\Delta G$ is predicted to have many competing alternate secondary structures that would make it difficult for the RNA to fold into the target binding-competent structure.

predicted to be unstructured and was found to be beneficial when added to scaffold 2 in a high-throughput CRISPRi assay (scaffold 208: SEQ ID NO:2268).

A second class of mutations was to the extended stem region. The sequence for this region was chosen from three possible options: (a) a "truncated stem loop" which has a shorter loop sequence than the reference sequence extended stem (the scaffolds 64 and 175 contain this extended stem: SEQ ID NOS: 2106 and 2239, respectively) (b) Uvsx hairpin with additional loop-distal mutations [A99] and G65T to fully base-pair the extended stem (the scaffold 174: SEQ ID NO: 2238) contains this extended stem); or (c) an "MS2 (U15C)" hairpin with the same additional loop-distal mutations [A99] and G65T as in (b). These three extended stems classes were present in scaffolds with high activity (e.g. see FIG. 65), and their sequences can be found in Table 27.

TABLE 27

Sequences of extended stern regions used in novel scaffolds.

| Extended stem name | Extended stem sequence | Incorporated in Scaffolds (SEQ ID NO) |
|---|---|---|
| truncated stein loop | GCGCUUACGGACUUCGGUCCGUAAGAAGC (SEQ ID NO: 4291) | 2239, 2242-2244, 2246, 2255-2258 |
| UvsX, -99 G65T | GCUCCCUCUUCGGAGGGAGC (SEQ ID NO: 4292) | 2238, 2245, 2250-2254, 2259-2280 |
| MS2(U15C), -99 G65T | GCUCACAUGAGGAUCACCCAUGUGAGC (SEQ ID NO: 4293) | 2249 |

A sequence with a low value for $\Delta\Delta G$ is predicted to be more optimal in terms of its ability to fold into a binding-competent secondary structure.

Thirdly, a set of mutations was designed to the triplex loop region. This region was not resolved in the CryoEM structure of CasX 1.1, likely because it does not form base-pairs and thus is more flexible. This region tolerates mutations, with certain mutations having beneficial effects on RNP binding, based on CRISPRi data from scaffold 2 (FIG. 63). The C18G substitution within the triplex loop was already incorporated in the scaffold 174. The following mutations were added to scaffold 174, that were not immediately adjacent to the C18G substitution in order to limit potential negative epistasis between these mutations: ^U15 (insertion of U before nucleotide 15 in scaffold 2), ^U17, and C16A (scaffolds 208, 210, and 209: SEQ ID NOS: 2268, 2270, 2269, respectively).

Fourth, a set of mutations was designed to systematically stabilize the target secondary structure for the scaffold. For background, RNA polymers fold into complex three-dimensional structures that enforce their function. In the CasX RNP, the RNA scaffold forms a structure comprising secondary structure elements such as the pseudoknot stem, a triplex, a scaffold stem-loop, and an extended stem-loop, as evident in the Cryo-EM characterization of the CasX RNP 1.1. These structural elements likely help enforce a three dimensional structure that is competent to bind the CasX protein, and in turn enable conformational transitions necessary for enzymatic function of the RNP. However, an RNA sequence can fold into alternate secondary structures that compete with the formation of the target secondary structure. The propensity of a given sequence to fold into the target versus alternate secondary structures was quantified using computational prediction, similar to the method described in (Jarmoskaite, I., et al. 2019. A quantitative and predictive model for RNA binding by human pumilio proteins. Molecular Cell 74(5), pp. 966-981.e18.) for correcting observed binding equilibrium constants for a distinct protein-RNA interaction, and using RNAfold (Lorenz, R., Bernhart, S. H., Höner Zu Siederdissen, C., et al. 2011. ViennaRNA Package 2.0. Algorithms for Molecular Biology 6, p. 26.) to predict secondary structure stability (see Methods).

A series of mutations were chosen that were predicted to help stabilize the target secondary structure, in the following regions: The pseudoknot is a base-paired stem that forms between the 5' sequence of the scaffold and sequence 3' of the triplex and triplex loop. This stem is predicted to comprise 5 base-pairs, 4 of which are canonical Watson-Crick pairs and the fifth is a noncanonical G:A wobble pair. Converting this G:A wobble to a Watson Crick pair is predicted to stabilize alternative secondary structures relative to the target secondary structure (high $\Delta\Delta G$ between target and alternative secondary structure stabilities; Methods). This aberrant stability comes from a set of secondary structures in which the triplex bases are aberrantly paired. However, converting the G to an A or a C (for an A:A wobble or C:A wobble) was predicted to lower the $\Delta\Delta G$ value (G8C or G8A added to scaffolds 174 and 175+C18G). A second set of mutations was in the triplex loop: including a U15C mutation and a C18G mutation (for scaffold 175 that does not already contain this variant). Finally, the linker between the pseudoknot stem and the scaffold stem was mutated at position 35 (U35A), which was again predicted to stabilize the target secondary structure relative to alternatives.

Scaffolds 189-198 (SEQ ID NOS:2250-2258) included these predicted mutations on top of scaffolds 174 or 175, individually and in combination. The predicted change in $\Delta\Delta G$ for each of these scaffolds is given in Table 28 below. This algorithm predicts a much stronger effect on $\Delta\Delta G$ with combining multiple of these mutations into a single scaffold.

TABLE 28

Predicted effect on target secondary structure stability of incorporating specific mutations individually or in combination to scaffolds 174 or 175.

| Starting scaffold | Mutation(s) | Scaffold $\Delta\Delta G$ (kcal/mol) | Effect of mutation(s) $\Delta\Delta G\_mut - \Delta\Delta G\_starting\_scaffold$ (kcal/mol) |
|---|---|---|---|
| 174 | — | 0.17 | — |
| 174 | G8A | −0.74 | −0.91 |
| 174 | G8C | −0.32 | −0.49 |
| 174 | U15C | −0.02 | −0.19 |
| 174 | U35A | −0.22 | −0.39 |
| 174 | G8A, U15C, U35A | −1.34 | −1.51 |
| 175 | — | 3.23 | — |
| 175 | G8A | 3.15 | −0.08 |
| 175 | G8C | 3.15 | −0.08 |
| 175 | U35A | 3.07 | −0.16 |
| 175 | U15C | 0.78 | −2.45 |
| 175 | C18G | 0.43 | −2.80 |
| 175 | G8A, T15C, C18G, T35A | −1.03 | −4.26 |

A fifth set of mutations was designed to test whether the triplex bases could be replaced by an alternate set of three nucleotides that are still able to form triplex pairs (Scaffolds 212-220: SEQ ID NOS:2272-2280). A subset of these substitutions are predicted to prevent formation of alternate secondary structures.

A sixth set of mutations were designed to change the pseudoknot-triplex boundary nucleotides, which are predicted to have competing effects on transcription efficiency and triplex formation. These include scaffolds 201-206 (SEQ ID NOS:2261-2266).

Example 28: In Vitro Cleavage Assays with NTC PAMs

Figure 73:
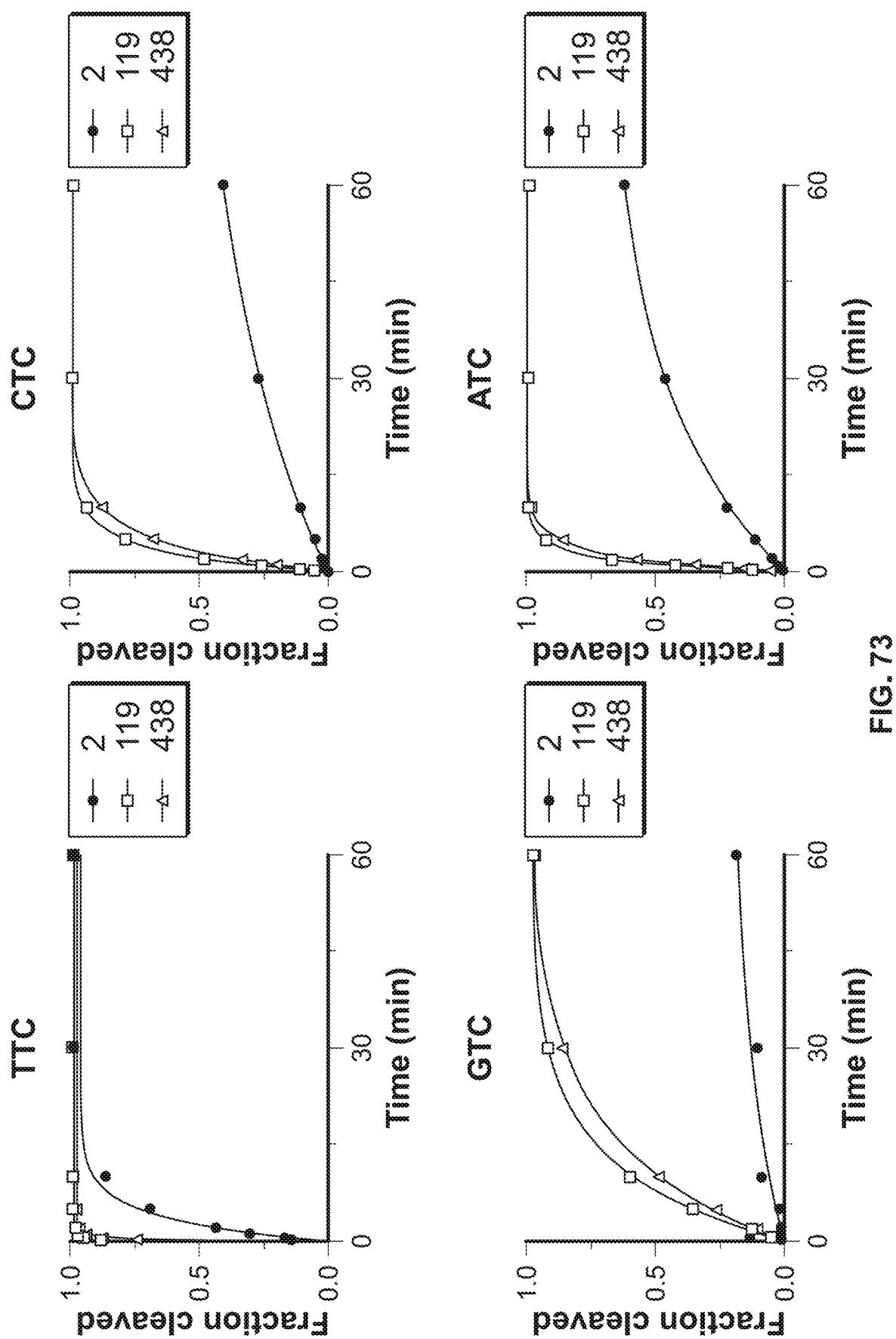
FIG. 73 shows the quantification of cleavage rates of RNP formed by sgRNA174 and the CasX variants on targets with different PAMs. Target DNA was incubated with a 20-fold excess of the indicated RNP and the amount of cleaved target was determined at the indicated time points. The monophasic fit of the combined replicates is shown.

In vitro cleavage assays were performed essentially as described in Example 19, using CasX 2 (SED ID NO:2), CasX 119, and CasX 438 complexed with single guide 174 with spacer 7.37 targeted against B32M. Fluorescently labeled dsDNA targets that would be complementary with a 7.37 spacer and either a TTC, CTC, GTC, or ATC PAM were used (The DNA sequences used to generate each dsDNA substrate are shown in Table 29. The PAM sequences for each are bolded. TS—target strand. NTS—Non-target strand). Target DNA was incubated with a 20-fold excess of the indicated RNP and the amount of cleaved target was determined at the indicated time points. The monophasic fit of the combined replicates is shown. During the assay, samples were taken at 0.25, 0.5, 1, 2, 5, 10, 30, and 60 minutes. Gels were imaged with an Amersham Typhoon and quantified using the IQTL 8.2 software. Apparent first-order rate constants for non-target strand cleavage ($k_{cleave}$) were determined for each Casx:sgRNA complex on each target. Rate constants for targets with non-TTC PAM were compared to the TTC PAM target to determine whether the relative preference for each PAM was altered for a given CasX variant. The results are shown in FIG. 73 (the monophasic fit of the combined replicates is shown) and Table 30. For all Cas X variants, the TTC PAM target sequence supported the highest cleavage rate, followed by the ATC, then the CTC, and finally the GTC target sequence. The CTC target supported cleavage 3.5-4.3% as fast as the TTC target; the GTC target supported cleavage 1.0-1.4% as fast; and the ATC target supported cleavage 6.5-8.3% as fast. Despite the lower kieave rates for the non-TTC PAM, the cleavage rates of the variants allow targets with ATC or CTC PAMs to be cleaved nearly completely within 10 minutes, and these increased cleavage rates relative to the wild-type CasX may be sufficient for effective genome editing in a human cell, supporting the utility of the CasX variants having an increased ability to utilize a larger spectrum of PAM sequences.

TABLE 29

Sequences of DNA substrates used in in vitro PAM cleavage assay.

| Assay Combination | DNA Substrate Sequence* |
|---|---|
| 7.37 TTC PAM TS | AGCGCGAGCACAGCTAAGGCCACGGAGCGAGACATCTCGGCCCGAATGCTGTCAGCTTCA (SEQ ID NO: 4404) |
| 7.37 TTC PAM NTS | TGAAGCTGACAGCATTCGGGCCGAGATGTCTCGCTCCGTGGCCTTAGCTGTGCTCGCGCT (SEQ ID NO: 4405) |
| 7.37 CTC PAM TS | AGCGCGAGCACAGCTAAGGCCACGGAGCGAGACATCTCGGCCCGAGTGCTGTCAGCTTCA (SEQ ID NO: 4406) |
| 7.37 CTC PAM NTS | TGAAGCTGACAGCACTCGGGCCGAGATGTCTCGCTCCGTGGCCTTAGCTGTGCTCGCGCT (SEQ ID NO: 4407 |
| 7.37 GTC PAM TS | AGCGCGAGCACAGCTAAGGCCACGGAGCGAGACATCTCGGCCCGACTGCTGTCAGCTTCA (SEQ ID NO: 4408) |
| 7.37 GTC PAM NTS | TGAAGCTGAGCAGTCGGGCCGAGATGTTCGCTCCGTGGCCTTAGCTGTGCTCGCGCT (SEQ ID NO: 4409) |
| 7.37 ATC PAM TS | AGCGCGAGCACAGCTAAGGCCACGGAGCGAGACATCTCGGCCCGATTGCTGTCAGCTTCA (SEQ ID NO: 4410) |
| 7.37 ATC PAM NTS | TGAAGCTGACAGCAATCGGGCCGAGATGTCTCGCTCCGTGGCCTTAGCTGTGCTCGCGCT (SEQ ID NO: 4411) |

*PAM indicated in bold

TABLE 30

Cleavage Rates

| CasX | $k_{cleave}$ Rate* | | | |
|---|---|---|---|---|
| | TTC | CTC | GTC | ATC |
| 2 | 0.267 min$^{-1}$ | 9.29E−3 min$^{-1}$ (0.035) | 3.75E−3 min$^{-1}$ (0.014) | 1.87E−2 min$^{-1}$ (0.070) |
| 119 | 8.33 min$^{-1}$ | 0.303 min$^{-1}$ (0.036) | 8.64E−2 min$^{-1}$ (0.010) | 0.540 min$^{-1}$ (0.065) |
| 438 | 4.94 min$^{-1}$ | 0.212 min$^{-1}$ (0.043) | 1.31E−2 min$^{-1}$ (0.013) | 0.408 min$^{-1}$ (0.083) |

*For all non-NTC PAMs, the relative cleavage rate as compared to the TTC rate for that variant is shown in parentheses.

SEQUENCE LISTING (4415 sequences)

SEQ ID NO: 1 - protein, 986 aa, Unknown
  Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, Unknown
  Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, Unknown
  Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, Artificial Sequence
  reference sgRNA
acaucuggcgcguuuauuccauuacuuuggagccagucccagcgacuaugucguauggacgaagcgcuuauuuaucggagagaaaccgauaaguaaaacgcaucaaag

SEQ ID NO: 5 - RNA, 108 nt, Artificial Sequence
  reference sgRNA
uacuggcgcuuuuaucucauuacuuugagagccaucaccagcgacuaugucguauggguaaagcgcuuauuuaucggagagaaauccgauaaauaagaagcaucaaag

SEQ ID NO: 6 - RNA, 81 nt, Artificial Sequence
  tracrRNA sequence
acaucuggcgcguuuauuccauuacuuuggagccagucccagcgacuaugucguauggacgaagcgcuuauuuaucggaga

SEQ ID NO: 7 - RNA, 78 nt, Artificial Sequence
  tracrRNA sequence
acaucuggcgcguuuauuccauuacuuuggagccagucccagcgacuaugucguauggacgaagcgcuuauuuaucgg

SEQ ID NO: 8 - RNA, 80 nt, Artificial Sequence
  tracrRNA sequence
uacuggcgcuuuuaucucauuacuuugagagccaucaccagcgacuaugucguauggguaaagcgcuuauuuaucggaga

SEQ ID NO: 9 - RNA, 77 nt, Artificial Sequence
  tracrRNA sequence
uacuggcgcuuuuaucucauuacuuugagagccaucaccagcgacuaugucguauggguaaagcgcuuauuuaucgg

SEQ ID NO: 10 - RNA, 25 nt, Artificial Sequence
  tracrRNA sequence
guuuacacacucccucucauagggu

SEQ ID NO: 11 - RNA, 25 nt, Artificial Sequence
  tracrRNA sequence
guuuacacacucccucucaugaggu

SEQ ID NO: 12 - RNA, 25 nt, Artificial Sequence
  tracrRNA sequence
uuuuacauacccccucucaugggau

SEQ ID NO: 13 - RNA, 25 nt, Artificial Sequence
  tracrRNA sequence
guuuacacacucccucucauggggg

SEQ ID NO: 14 - RNA, 20 nt, Artificial Sequence
  reference sgRNA
ccagcgacuaugucguaugg

SEQ ID NO: 15 - RNA, 39 nt, Artificial Sequence
  reference sgRNA
gcgcuuauuuaucggagagaaauccgauaaauaagaagc

SEQ ID NO: 16 - RNA, 74 nt, Artificial Sequence
  reference sgRNA
ggcgcuuuuaucucauuacuuugagagccaucaccagcgacuaugucguauggguaaagcgcuuauuuaucgga

SEQ ID NO: 17 - DNA, 14 bp, Artificial Sequence
  sgNA variant
attatctcattact

SEQ ID NO: 18 - DNA, 24 bp, Artificial Sequence
  gNA variant
tccgaggggaccgtcccctcggta

SEQ ID NO: 19 - DNA, 45 bp, Artificial Sequence
  gNA variant
ggccggcatggtcccagcctcctcgctggcgccggctgggaacat

SEQ ID NO: 20 - DNA, 16 bp, Artificial Sequence
  gNA variant
atggcgaatgggaccc

SEQ ID NO: 21 - DNA, 78 bp, Artificial Sequence
  gNA variant
ttttggccggcatggtcccagcctcctcgctggcgccggctgggcaacatgcttcggcatggcgaatgggaccccggg

SEQ ID NO: 22 - DNA, 78 bp, Artificial Sequence
  gNA variant
cccggggtcccattcgccatgccgaagcatgttgcccagccggcgccagcgaggaggctgggaccatgccggccaaaa

SEQ ID NO: 23 - DNA, 98 bp, Artificial Sequence
  sgNA variant
tactggcgcctttatctcattactttgagagccatcaccagcgactatgtcgtatgggtaaagcgcttacggacttcggtccgtaagaagcatcaaag

SEQ ID NO: 24 - DNA, 20 bp, Artificial Sequence
  spacer sequence
gtgtagtacaagagatagaa

SEQ ID NO: 25 - DNA, 20 bp, Artificial Sequence
  spacer sequence
tgaagctgacagcattcggg

SEQ ID NO: 26 - DNA, 20 bp, Artificial Sequence
  spacer sequence
tagatcgagacatgtaagca

SEQ ID NO: 27 - DNA, 20 bp, Artificial Sequence
  spacer sequence
ggccgagatgtctcgctccg

SEQ ID NO: 28 - DNA, 20 bp, Artificial Sequence
  spacer sequence
aggccagaaagagagagtag

SEQ ID NO: 29 - DNA, 20 bp, Artificial Sequence
  spacer sequence
tgtggtcggggtagcggctg

SEQ ID NO: 30 - DNA, 20 bp, Artificial Sequence
  spacer sequence
tcaagtccgccatgcccgaa

SEQ ID NO: 31 - DNA, 20 bp, Artificial Sequence
  spacer sequence
ccagggtgtcgccctcgaac

SEQ ID NO: 32 - DNA, 20 bp, Artificial Sequence
  spacer sequence
tgaccaccctgacctacggc

SEQ ID NO: 33 - DNA, 20 bp, Artificial Sequence
  spacer sequence
tggggcacaagctggagtac

SEQ ID NO: 34 - DNA, 20 bp, Unknown
  spacer sequence
gtcgtgctgcttcatgcaac

SEQ ID NO: 35 - DNA, 20 bp, Unknown
  spacer sequence
gtcgtgctgctttgcatggt

SEQ ID NO: 36 - DNA, 20 bp, Unknown
  spacer sequence
gtcgtgctatcccatgtggt

SEQ ID NO: 37 - DNA, 20 bp, Unknown
  spacer sequence
gtcgcatcgcttcatgtggt

SEQ ID NO: 38 - DNA, 20 bp, Unknown
  spacer sequence
actatgctgcttcatgtggt

SEQ ID NO: 39 - DNA, 20 bp, Unknown
  spacer sequence
gtcgtgctgcttcatacagt

SEQ ID NO: 40 - DNA, 20 bp, Unknown
  spacer sequence
gtcgtgctgctttgcgtggt

SEQ ID NO: 41 - DNA, 20 bp, Unknown
  spacer sequence
gtcgtgctgtcccatgtggt

SEQ ID NO: 42 - DNA, 20 bp, Unknown
  spacer sequence
gtcgtgtcacttcatgtggt

SEQ ID NO: 43 - DNA, 20 bp, Unknown
  spacer sequence
gtcacactgcttcatgtggt

SEQ ID NO: 44 - DNA, 20 bp, Unknown
  spacer sequence
actgtgctgcttcatgtggt

SEQ ID NO: 45 - DNA, 20 bp, Unknown
  spacer sequence
gtcgtgctgcttcatgtgac

SEQ ID NO: 46 - DNA, 20 bp, Unknown
  spacer sequence
gtcgtgctgcttcatgcagt

SEQ ID NO: 47 - DNA, 20 bp, Unknown
  spacer sequence
gtcgtgctgcttcacatggt

SEQ ID NO: 48 - DNA, 20 bp, Unknown
  spacer sequence
gtcgtgctgctttgtgtggt

SEQ ID NO: 49 - DNA, 20 bp, Unknown
  spacer sequence
gtcgtgctgccccatgtggt

SEQ ID NO: 50 - DNA, 20 bp, Unknown
  spacer sequence
gtcgtgctatttcatgtggt

SEQ ID NO: 51 - DNA, 20 bp, Unknown
  spacer sequence
gtcgtgtcgcttcatgtggt

SEQ ID NO: 52 - DNA, 20 bp, Unknown
  spacer sequence
gtcgcactgcttcatgtggt

SEQ ID NO: 53 - DNA, 20 bp, Unknown
  spacer sequence
gttatgctgcttcatgtggt

SEQ ID NO: 54 - DNA, 20 bp, Unknown
  spacer sequence
accgtgctgcttcatgtggt

SEQ ID NO: 55 - DNA, 20 bp, Unknown
  spacer sequence
gtcgtgctgcttcatgtgat

SEQ ID NO: 56 - DNA, 20 bp, Unknown
  spacer sequence
gtcgtgctgcttcatgcggt

SEQ ID NO: 57 - DNA, 20 bp, Unknown
  spacer sequence
gtcgtgctgcttcacgtggt

SEQ ID NO: 58 - DNA, 20 bp, Unknown
  spacer sequence
gtcgtgctgctttatgtggt

SEQ ID NO: 59 - DNA, 20 bp, Unknown
  spacer sequence
gtcgtgctgcctcatgtggt

SEQ ID NO: 60 - DNA, 20 bp, Unknown
  spacer sequence
gtcgtgctacttcatgtggt

SEQ ID NO: 61 - DNA, 20 bp, Unknown
  spacer sequence
gtcgtgttgcttcatgtggt

SEQ ID NO: 62 - DNA, 20 bp, Unknown
  spacer sequence
gtcgcgctgcttcatgtggt

SEQ ID NO: 63 - DNA, 20 bp, Unknown
  spacer sequence
gttgtgctgcttcatgtggt

SEQ ID NO: 64 - DNA, 20 bp, Unknown
  spacer sequence
atcgtgctgcttcatgtggt

SEQ ID NO: 65 - DNA, 20 bp, Unknown
  spacer sequence
gtcgtgctgcttcatgtggt

SEQ ID NO: 66 - DNA, 23 bp, Unknown
  spacer sequence
gaagtcgtgctgcttcatgtaac

SEQ ID NO: 67 - DNA, 23 bp, Unknown
  spacer sequence
gaagtcgtgctgcttcgcacggt

SEQ ID NO: 68 - DNA, 23 bp, Unknown
  spacer sequence
gaagtcgtgctgtcctatgtggt

SEQ ID NO: 69 - DNA, 23 bp, Unknown
  spacer sequence
gaagtcgtatcacttcatgtggt

SEQ ID NO: 70 - DNA, 23 bp, Unknown
  spacer sequence
gaagctacgctgcttcatgtggt

SEQ ID NO: 71 - DNA, 23 bp, Unknown
  spacer sequence
aggatcgtgctgcttcatgtggt

SEQ ID NO: 72 - DNA, 23 bp, Unknown
  spacer sequence
gaagtcgtgctgcttcatgtgac

SEQ ID NO: 73 - DNA, 23 bp, Unknown
  spacer sequence
gaagtcgtgctgcttcatacagt

SEQ ID NO: 74 - DNA, 23 bp, Unknown
  spacer sequence
gaagtcgtgctgctttgcgtggt

SEQ ID NO: 75 - DNA, 23 bp, Unknown
  spacer sequence
gaagtcgtgctgtcccatgtggt

SEQ ID NO: 76 - DNA, 23 bp, Unknown
  spacer sequence
gaagtcgtgtcacttcatgtggt

SEQ ID NO: 77 - DNA, 23 bp, Unknown
  spacer sequence
gaagtcacactgcttcatgtggt

SEQ ID NO: 78 - DNA, 23 bp, Unknown
  spacer sequence
gaaactgtgctgcttcatgtggt

SEQ ID NO: 79 - DNA, 23 bp, Unknown
  spacer sequence
agggtcgtgctgcttcatgtggt

SEQ ID NO: 80 - DNA, 23 bp, Unknown
  spacer sequence
gaagtcgtgctgcttcatgtaat

SEQ ID NO: 81 - DNA, 23 bp, Unknown
  spacer sequence
gaagtcgtgctgcttcatacggt

SEQ ID NO: 82 - DNA, 23 bp, Unknown
  spacer sequence
gaagtcgtgctgcttcgcgtggt

SEQ ID NO: 83 - DNA, 23 bp, Unknown
  spacer sequence
gaagtcgtgctgctctatgtggt

SEQ ID NO: 84 - DNA, 23 bp, Unknown
  spacer sequence
gaagtcgtgctgtctcatgtggt

SEQ ID NO: 85 - DNA, 23 bp, Unknown
  spacer sequence
gaagtcgtgccacttcatgtggt

SEQ ID NO: 86 - DNA, 23 bp, Unknown
  spacer sequence
gaagtcgtattgcttcatgtggt

SEQ ID NO: 87 - DNA, 23 bp, Unknown
  spacer sequence
gaagtcacgctgcttcatgtggt

SEQ ID NO: 88 - DNA, 23 bp, Unknown
  spacer sequence
gaagctgtgctgcttcatgtggt

SEQ ID NO: 89 - DNA, 23 bp, Unknown
  spacer sequence
gagatcgtgctgcttcatgtggt

SEQ ID NO: 90 - DNA, 23 bp, Unknown
  spacer sequence
agagtcgtgctgcttcatgtggt

SEQ ID NO: 91 - DNA, 23 bp, Unknown
  spacer sequence
gaagtcgtgctgcttcatgtggc

SEQ ID NO: 92 - DNA, 23 bp, Unknown
  spacer sequence
gaagtcgtgctgcttcatgtagt

SEQ ID NO: 93 - DNA, 23 bp, Unknown
  spacer sequence
gaagtcgtgctgcttcatatggt

SEQ ID NO: 94 - DNA, 23 bp, Unknown
  spacer sequence
gaagtcgtgctgcttcgtgtggt

SEQ ID NO: 95 - DNA, 23 bp, Unknown
  spacer sequence
gaagtcgtgctgctccatgtggt

SEQ ID NO: 96 - DNA, 23 bp, Unknown
  spacer sequence
gaagtcgtgctgtttcatgtggt

SEQ ID NO: 97 - DNA, 23 bp, Unknown
  spacer sequence
gaagtcgtgccgcttcatgtggt

SEQ ID NO: 98 - DNA, 23 bp, Unknown
  spacer sequence
gaagtcgtactgcttcatgtggt

SEQ ID NO: 99 - DNA, 23 bp, Unknown
  spacer sequence
gaagtcatgctgcttcatgtggt

SEQ ID NO: 100 - DNA, 23 bp, Unknown
  spacer sequence
gaagccgtgctgcttcatgtggt

SEQ ID NO: 101 - DNA, 23 bp, Unknown
  spacer sequence
gaggtcgtgctgcttcatgtggt

SEQ ID NO: 102 - DNA, 23 bp, Unknown
  spacer sequence
aaagtcgtgctgcttcatgtggt

SEQ ID NO: 103 - DNA, 23 bp, Unknown
  spacer sequence
gaagtcgtgctgcttcatgtggt

SEQ ID NO: 104 - DNA, 20 bp, Unknown
  spacer sequence
agggcgacaccctggtaggt

SEQ ID NO: 105 - DNA, 20 bp, Unknown
  spacer sequence
agggcgacaccccaacgaac

SEQ ID NO: 106 - DNA, 20 bp, Unknown
  spacer sequence
agggcgacgttttggtgaac

SEQ ID NO: 107 - DNA, 20 bp, Unknown
  spacer sequence
agggtagtaccctggtgaac

SEQ ID NO: 108 - DNA, 20 bp, Unknown
  spacer sequence
gaaacgacaccctggtgaac

SEQ ID NO: 109 - DNA, 20 bp, Unknown
  spacer sequence
agggcgacaccctggcagac

SEQ ID NO: 110 - DNA, 20 bp, Unknown
  spacer sequence
agggcgacaccccaatgaac

SEQ ID NO: 111 - DNA, 20 bp, Unknown
  spacer sequence
agggcgacattttggtgaac

SEQ ID NO: 112 - DNA, 20 bp, Unknown
  spacer sequence
agggcggtgccctggtgaac

SEQ ID NO: 113 - DNA, 20 bp, Unknown
  spacer sequence
aggataacaccctggtgaac

SEQ ID NO: 114 - DNA, 20 bp, Unknown
  spacer sequence
gaagcgacaccctggtgaac

SEQ ID NO: 115 - DNA, 20 bp, Unknown
  spacer sequence
agggcgacaccctggtgagt

SEQ ID NO: 116 - DNA, 20 bp, Unknown
  spacer sequence
agggcgacaccctggtagac

SEQ ID NO: 117 - DNA, 20 bp, Unknown
  spacer sequence
agggcgacaccctgacgaac

SEQ ID NO: 118 - DNA, 20 bp, Unknown
  spacer sequence
agggcgacaccccagtgaac

SEQ ID NO: 119 - DNA, 20 bp, Unknown
  spacer sequence
agggcgacactttggtgaac

SEQ ID NO: 120 - DNA, 20 bp, Unknown
  spacer sequence
agggcgacgtcctggtgaac

SEQ ID NO: 121 - DNA, 20 bp, Unknown
  spacer sequence
agggcggtaccctggtgaac

SEQ ID NO: 122 - DNA, 20 bp, Unknown
  spacer sequence
agggtaacaccctggtgaac

SEQ ID NO: 123 - DNA, 20 bp, Unknown
  spacer sequence
agaacgacaccctggtgaac

SEQ ID NO: 124 - DNA, 20 bp, Unknown
  spacer sequence
gaggcgacaccctggtgaac

SEQ ID NO: 125 - DNA, 20 bp, Unknown
  spacer sequence
agggcgacaccctggtgagc

SEQ ID NO: 126 - DNA, 20 bp, Unknown
  spacer sequence
agggcgacaccctggtaaac

SEQ ID NO: 127 - DNA, 20 bp, Unknown
  spacer sequence
agggcgacaccctgatgaac

SEQ ID NO: 128 - DNA, 20 bp, Unknown
  spacer sequence
agggcgacaccccggtgaac

SEQ ID NO: 129 - DNA, 20 bp, Unknown
  spacer sequence
agggcgacactctggtgaac

SEQ ID NO: 130 - DNA, 20 bp, Unknown
  spacer sequence
agggcgacgccctggtgaac

SEQ ID NO: 131 - DNA, 20 bp, Unknown
  spacer sequence
agggcggcaccctggtgaac

SEQ ID NO: 132 - DNA, 20 bp, Unknown
  spacer sequence
agggtgacaccctggtgaac

SEQ ID NO: 133 - DNA, 20 bp, Unknown
  spacer sequence
agagcgacaccctggtgaac

SEQ ID NO: 134 - DNA, 20 bp, Unknown
  spacer sequence
ggggcgacaccctggtgaac

SEQ ID NO: 135 - DNA, 20 bp, Unknown
  spacer sequence
agggcgacaccctggtgaac

SEQ ID NO: 136 - DNA, 20 bp, Unknown
  spacer sequence
gaagttcgagggtagtaccc

SEQ ID NO: 137 - DNA, 20 bp, Unknown
  spacer sequence
gaagttcggaaacgacaccc

SEQ ID NO: 138 - DNA, 20 bp, Unknown
  spacer sequence
gaagcctaagggcgacaccc

SEQ ID NO: 139 - DNA, 20 bp, Unknown
  spacer sequence
aggattcgagggcgacaccc

SEQ ID NO: 140 - DNA, 20 bp, Unknown
  spacer sequence
gaagttcgagggcgatgtcc

SEQ ID NO: 141 - DNA, 20 bp, Unknown
  spacer sequence
gaagttcgagggtagcaccc

SEQ ID NO: 142 - DNA, 20 bp, Unknown
  spacer sequence
gaagttcgaaaacgacaccc

SEQ ID NO: 143 - DNA, 20 bp, Unknown
  spacer sequence
gaagtttaggggcgacaccc

SEQ ID NO: 144 - DNA, 20 bp, Unknown
  spacer sequence
gaaacccgagggcgacaccc

SEQ ID NO: 145 - DNA, 20 bp, Unknown
  spacer sequence
agggttcgagggcgacaccc

SEQ ID NO: 146 - DNA, 20 bp, Unknown
  spacer sequence
gaagttcgagggcgacactt

SEQ ID NO: 147 - DNA, 20 bp, Unknown
  spacer sequence
gaagttcgagggcgacgtcc

SEQ ID NO: 148 - DNA, 20 bp, Unknown
  spacer sequence
gaagttcgagggcggtaccc

SEQ ID NO: 149 - DNA, 20 bp, Unknown
  spacer sequence
gaagttcgagggtaacaccc

SEQ ID NO: 150 - DNA, 20 bp, Unknown
  spacer sequence
gaagttcgagaacgacaccc

SEQ ID NO: 151 - DNA, 20 bp, Unknown
  spacer sequence
gaagttcggaggcgacaccc

SEQ ID NO: 152 - DNA, 20 bp, Unknown
  spacer sequence
gaagtttaagggcgacaccc

SEQ ID NO: 153 - DNA, 20 bp, Unknown
  spacer sequence
gaagcccgagggcgacaccc

SEQ ID NO: 154 - DNA, 20 bp, Unknown
  spacer sequence
gagattcgagggcgacaccc

SEQ ID NO: 155 - DNA, 20 bp, Unknown
  spacer sequence
agagttcgagggcgacaccc

SEQ ID NO: 156 - DNA, 20 bp, Unknown
  spacer sequence
gaagttcgagggcgacactc

SEQ ID NO: 157 - DNA, 20 bp, Unknown
  spacer sequence
gaagttcgagggcgacgccc

SEQ ID NO: 158 - DNA, 20 bp, Unknown
  spacer sequence
gaagttcgagggcggcaccc

SEQ ID NO: 159 - DNA, 20 bp, Unknown
  spacer sequence
gaagttcgagggtgacaccc

SEQ ID NO: 160 - DNA, 20 bp, Unknown
  spacer sequence
gaagttcgagagcgacaccc

SEQ ID NO: 161 - DNA, 20 bp, Unknown
  spacer sequence
gaagttcgggggcgacaccc

SEQ ID NO: 162 - DNA, 20 bp, Unknown
  spacer sequence
gaagtttgagggcgacaccc

SEQ ID NO: 163 - DNA, 20 bp, Unknown
  spacer sequence
gaagctcgagggcgacaccc

SEQ ID NO: 164 - DNA, 20 bp, Unknown
  spacer sequence
gaggttcgagggcgacaccc

SEQ ID NO: 165 - DNA, 20 bp, Unknown
  spacer sequence
aaagttcgagggcgacaccc

SEQ ID NO: 166 - DNA, 20 bp, Unknown
  spacer sequence
gaagttcgagggcgacaccc

SEQ ID NO: 167 - DNA, 23 bp, Unknown
  spacer sequence
tcgccctcgaacttcacctcaat

SEQ ID NO: 168 - DNA, 24 bp, Unknown
  spacer sequence
tcgccctcgaacttcattcctggc

SEQ ID NO: 169 - DNA, 23 bp, Unknown
  spacer sequence
tcgccctcgaaccctgcctcggc

SEQ ID NO: 170 - DNA, 23 bp, Unknown
  spacer sequence
tcgccctcaggtttcacctcggc

SEQ ID NO: 171 - DNA, 23 bp, Unknown
  spacer sequence
tcgcttctgaacttcacctcggc

SEQ ID NO: 172 - DNA, 23 bp, Unknown
  spacer sequence
ctatcctcgaacttcacctcggc

SEQ ID NO: 173 - DNA, 23 bp, Unknown
  spacer sequence
tcgccctcgaacttcacctcgat

SEQ ID NO: 174 - DNA, 23 bp, Unknown
  spacer sequence
tcgccctcgaacttcaccctagc

SEQ ID NO: 175 - DNA, 23 bp, Unknown
  spacer sequence
tcgccctcgaacttcgtttcggc

SEQ ID NO: 176 - DNA, 23 bp, Unknown
  spacer sequence
tcgccctcgaaccctacctcggc

SEQ ID NO: 177 - DNA, 23 bp, Unknown
  spacer sequence
tcgccctcgggtttcacctcggc

SEQ ID NO: 178 - DNA, 23 bp, Unknown
  spacer sequence
tcgcccctaaacttcacctcggc

SEQ ID NO: 179 - DNA, 23 bp, Unknown
  spacer sequence
tcgttttcgaacttcacctcggc

SEQ ID NO: 180 - DNA, 23 bp, Unknown
  spacer sequence
ctaccctcgaacttcacctcggc

SEQ ID NO: 181 - DNA, 23 bp, Unknown
  spacer sequence
tcgccctcgaacttcacctcaac

SEQ ID NO: 182 - DNA, 23 bp, Unknown
  spacer sequence
tcgccctcgaacttcaccctggc

SEQ ID NO: 183 - DNA, 23 bp, Unknown
  spacer sequence
tcgccctcgaacttcatttcggc

SEQ ID NO: 184 - DNA, 23 bp, Unknown
  spacer sequence
tcgccctcgaactttgcctcggc

SEQ ID NO: 185 - DNA, 23 bp, Unknown
  spacer sequence
tcgccctcgaaccccacctcggc

SEQ ID NO: 186 - DNA, 23 bp, Unknown
  spacer sequence
tcgccctcgagtttcacctcggc

SEQ ID NO: 187 - DNA, 23 bp, Unknown
  spacer sequence
tcgccctcagacttcacctcggc

SEQ ID NO: 188 - DNA, 23 bp, Unknown
  spacer sequence
tcgcccctgaacttcacctcggc

SEQ ID NO: 189 - DNA, 23 bp, Unknown
  spacer sequence
tcgctttcgaacttcacctcggc

SEQ ID NO: 190 - DNA, 23 bp, Unknown
  spacer sequence
tcatcctcgaacttcacctcggc

SEQ ID NO: 191 - DNA, 23 bp, Unknown
  spacer sequence
ctgccctcgaacttcacctcggc

SEQ ID NO: 192 - DNA, 23 bp, Unknown
  spacer sequence
tcgccctcgaacttcacctcggt

SEQ ID NO: 193 - DNA, 23 bp, Unknown
  spacer sequence
tcgccctcgaacttcacctcagc

SEQ ID NO: 194 - DNA, 23 bp, Unknown
  spacer sequence
tcgccctcgaacttcaccccggc

SEQ ID NO: 195 - DNA, 23 bp, Unknown
  spacer sequence
tcgccctcgaacttcatctcggc

SEQ ID NO: 196 - DNA, 23 bp, Unknown
  spacer sequence
tcgccctcgaactttacctcggc

SEQ ID NO: 197 - DNA, 23 bp, Unknown
  spacer sequence
tcgccctcgaacctcacctcggc

SEQ ID NO: 198 - DNA, 23 bp, Unknown
  spacer sequence
tcgccctcgagcttcacctcggc

SEQ ID NO: 199 - DNA, 23 bp, Unknown
  spacer sequence
tcgccctcaaacttcacctcggc

SEQ ID NO: 200 - DNA, 23 bp, Unknown
  spacer sequence
tcgcccccgaacttcacctcggc

SEQ ID NO: 201 - DNA, 23 bp, Unknown
  spacer sequence
tcgctctcgaacttcacctcggc

SEQ ID NO: 202 - DNA, 23 bp, Unknown
  spacer sequence
tcaccctcgaacttcacctcggc

SEQ ID NO: 203 - DNA, 23 bp, Unknown
  spacer sequence
ccgccctcgaacttcacctcggc

SEQ ID NO: 204 - DNA, 23 bp, Unknown
  spacer sequence
tcgccctcgaacttcacctcggc

SEQ ID NO: 205 - DNA, 20 bp, Unknown
  spacer sequence
tgtggtcggggtagcgatca

SEQ ID NO: 206 - DNA, 20 bp, Unknown
  spacer sequence
tgtggtcggggtgatagctg

SEQ ID NO: 207 - DNA, 20 bp, Unknown
  spacer sequence
tgtggtcgaaacagcggctg

SEQ ID NO: 208 - DNA, 20 bp, Unknown
  spacer sequence
tgtgactagggtagcggctg

SEQ ID NO: 209 - DNA, 20 bp, Unknown
  spacer sequence
cacagtcggggtagcggctg

SEQ ID NO: 210 - DNA, 20 bp, Unknown
  spacer sequence
tgtggtcggggtagcaattg

SEQ ID NO: 211 - DNA, 20 bp, Unknown
  spacer sequence
tgtggtcggggtgatggctg

SEQ ID NO: 212 - DNA, 20 bp, Unknown
  spacer sequence
tgtggtcggaacagcggctg

SEQ ID NO: 213 - DNA, 20 bp, Unknown
  spacer sequence
tgtggttaaggtagcggctg

SEQ ID NO: 214 - DNA, 20 bp, Unknown
  spacer sequence
tgtaaccggggtagcggctg

SEQ ID NO: 215 - DNA, 20 bp, Unknown
  spacer sequence
cacggtcggggtagcggctg

SEQ ID NO: 216 - DNA, 20 bp, Unknown
  spacer sequence
tgtggtcggggtagcggcca

SEQ ID NO: 217 - DNA, 20 bp, Unknown
  spacer sequence
tgtggtcggggtagcgattg

SEQ ID NO: 218 - DNA, 20 bp, Unknown
  spacer sequence
tgtggtcggggtagtagctg

SEQ ID NO: 219 - DNA, 20 bp, Unknown
  spacer sequence
tgtggtcggggtgacggctg

SEQ ID NO: 220 - DNA, 20 bp, Unknown
  spacer sequence
tgtggtcgggacagcggctg

SEQ ID NO: 221 - DNA, 20 bp, Unknown
  spacer sequence
tgtggtcgaagtagcggctg

SEQ ID NO: 222 - DNA, 20 bp, Unknown
  spacer sequence
tgtggttagggtagcggctg

SEQ ID NO: 223 - DNA, 20 bp, Unknown
  spacer sequence
tgtgaccggggtagcggctg

SEQ ID NO: 224 - DNA, 20 bp, Unknown
  spacer sequence
tgcagtcggggtagcggctg

SEQ ID NO: 225 - DNA, 20 bp, Unknown
  spacer sequence
catggtcggggtagcggctg

SEQ ID NO: 226 - DNA, 20 bp, Unknown
  spacer sequence
tgtggtcggggtagcggccg

SEQ ID NO: 227 - DNA, 20 bp, Unknown
  spacer sequence
tgtggtcggggtagcgactg

SEQ ID NO: 228 - DNA, 20 bp, Unknown
  spacer sequence
tgtggtcggggtagtggctg

SEQ ID NO: 229 - DNA, 20 bp, Unknown
  spacer sequence
tgtggtcggggtggcggctg

SEQ ID NO: 230 - DNA, 20 bp, Unknown
  spacer sequence
tgtggtcgggatagcggctg

SEQ ID NO: 231 - DNA, 20 bp, Unknown
  spacer sequence
tgtggtcgaggtagcggctg

SEQ ID NO: 232 - DNA, 20 bp, Unknown
  spacer sequence
tgtggttggggtagcggctg

SEQ ID NO: 233 - DNA, 20 bp, Unknown
  spacer sequence
tgtgatcggggtagcggctg

SEQ ID NO: 234 - DNA, 20 bp, Unknown
  spacer sequence
tgcggtcggggtagcggctg

SEQ ID NO: 235 - DNA, 20 bp, Unknown
  spacer sequence
cgtggtcggggtagcggctg

SEQ ID NO: 236 - DNA, 20 bp, Unknown
  spacer sequence
tgtggtcggggtagcggctg

SEQ ID NO: 237 - RNA, 26 nt, Unknown
  scaffold stem loop of an exemplary reference sgRNA
ccaucaccagcgacuaugucguaugg

SEQ ID NO: 238 - RNA, 46 nt, Unknown
  extended stem loop sequence of an exemplary reference sgRNA
guaaacgcuuauuuaucggagagaaauccgauaaauaagaagcauc

SEQ ID NO: 239 - DNA, 20 bp, Artificial Sequence
  SOD1 targeting spacer 2
atgttcatgagtttggagat

SEQ ID NO: 240 - RNA, 31 nt, Artificial Sequence
  stem loop sequence
  misc_feature (4)..(28): n is any ribonucleotide
  misc_feature (8)..(28): These individual nucleotides may be absent
uuunnnnnnnnnnnnnnnnnnnnnnnnnuuu

SEQ ID NO: 241 - RNA, 21 nt, Artificial Sequence
  stem loop sequence
  misc_feature (4)..(28): n is any ribonucleotide
  misc_feature (8)..(18): These individual nucleotides may be absent
uuunnnnnnnnnnnnnnnuuu

SEQ ID NO: 242 - RNA, 20 nt, Artificial Sequence
  scaffold stem loop sequence of a gNA
ccagcgacuaugucguaugg

SEQ ID NO: 243 - RNA, 23 nt, Unknown
  crRNA sequence
ccgauaaguaaaacgcaucaaag

SEQ ID NO: 244 - RNA, 26 nt, Unknown
  crRNA sequence
ucuccgauaaauaagaagcaucaaag

SEQ ID NO: 245 - RNA, 21 nt, Unknown
  scaffold stem loop
ccagcgacuaugucguagugg

SEQ ID NO: 246 - protein, 4 aa, Unknown
  zinc finger/ribbon domain
  SITE (2)..(3): Xaa is any amino acid
CXXC

SEQ ID NO: 247 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 248 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 249 - protein, 985 aa, Artificial Sequence
  CasX variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 250 - protein, 986 aa, Artificial Sequence
  CasX variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 251 - protein, 921 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 252 - protein, 920 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 253 - protein, 977 aa, Artificial Sequence
  CasX variant
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 254 - protein, 986 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 255 - protein, 925 aa, Artificial Sequence
  CasX variant
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 256 - protein, 975 aa, Artificial Sequence
  CasX variant
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 257 - protein, 982 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 258 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 259 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 260 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 261 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 262 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 263 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 264 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 265 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 266 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 267 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 268 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 269 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 270 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 271 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 272 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 273 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 274 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 275 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 276 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 277 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 278 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 279 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 280 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 281 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 282 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 283 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 284 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 285 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 286 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 287 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 288 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 289 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 290 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 291 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 292 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 293 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 294 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 295 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 296 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 297 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 298 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 299 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 300 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 301 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 302 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 303 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 304 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 305 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 306 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 307 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 308 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 309 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 310 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 311 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 312 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 313 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 314 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 315 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 316 - protein, 977 aa, Artificial Sequence; identical to SEQ ID NO: 270
  CasX variant

SEQ ID NO: 317 - protein, 977 aa, Artificial Sequence; identical to SEQ ID NO: 270
  CasX variant

SEQ ID NO: 318 - protein, 977 aa, Artificial Sequence; identical to SEQ ID NO: 270
  CasX variant

SEQ ID NO: 319 - protein, 977 aa, Artificial Sequence; identical to SEQ ID NO: 270
  CasX variant

SEQ ID NO: 320 - protein, 977 aa, Artificial Sequence; identical to SEQ ID NO: 270
  CasX variant

SEQ ID NO: 321 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 322 - protein, 977 aa, Artificial Sequence; identical to SEQ ID NO: 270
  CasX variant

SEQ ID NO: 323 - protein, 977 aa, Artificial Sequence; identical to SEQ ID NO: 270
  CasX variant

SEQ ID NO: 324 - protein, 977 aa, Artificial Sequence; identical to SEQ ID NO: 270
  CasX variant

SEQ ID NO: 325 - protein, 977 aa, Artificial Sequence; identical to SEQ ID NO: 270
  CasX variant

SEQ ID NO: 326 - protein, 977 aa, Artificial Sequence; identical to SEQ ID NO: 270
  CasX variant

SEQ ID NO: 327 - protein, 977 aa, Artificial Sequence; identical to SEQ ID NO: 270
  CasX variant

SEQ ID NO: 328 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 329 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 330 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 331 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 332 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 333 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 334 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 335 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 336 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 337 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 338 - protein, 84 aa, Unknown
  chloroplast transit peptide
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 339 - protein, 57 aa, Unknown
  chloroplast transit peptide
MASMISSSAVTTVSRASRGQSAAMAPFGGLKSMTGFPVRKVNTDITSITSNGGRVKS

SEQ ID NO: 340 - protein, 85 aa, Unknown
  chloroplast transit peptide
MASSMLSSATMVASPAQATMVAPFNGLKSSAAFPATRKANNDITSITSNGGRVNCMQVWPPIEKKKFETLSYLPDLTDSGGRVNC

SEQ ID NO: 341 - protein, 76 aa, Unknown
  chloroplast transit peptide
MAQVSRICNGVQNPSLISNLSKSSQRKSPLSVSLKTQQHPRAYPISSSWGLKKSGMTLIGSELRPLKVMSSVSTAC

SEQ ID NO: 342 - protein, 76 aa, Unknown
  chloroplast transit peptide
MAQVSRICNGVWNPSLISNLSKSSQRKSPLSVSLKTQQHPRAYPISSSWGLKKSGMTLIGSELRPLKVMSSVSTAC

SEQ ID NO: 343 - protein, 72 aa, Unknown
  chloroplast transit peptide
MAQINNMAQGIQTLNPNSNFHKPQVPKSSSFLVFGSKKLKNSANSMLVLKKDSIFMQLFCSFRISASVATAC

SEQ ID NO: 344 - protein, 69 aa, Unknown
  chloroplast transit peptide
MAALVTSQLATSGTVLSVTDRFRRPGFQGLRPRNPADAALGMRTVGASAAPKQSRKPHRFDRRCLSMVV

SEQ ID NO: 345 - protein, 77 aa, Unknown
  chloroplast transit peptide
MAALTTSQLATSATGFGIADRSAPSSLLRHGFQGLKPRSPAGGDATSLSVTTSARATPKQQRSVQRGSRRFPSVVVC

SEQ ID NO: 346 - protein, 57 aa, Unknown
  chloroplast transit peptide
MASSVLSSAAVATRSNVAQANMVAPFTGLKSAASFPVSRKQNLDITSIASNGGRVQC

SEQ ID NO: 347 - protein, 65 aa, Unknown
  chloroplast transit peptide
MESLAATSVFAPSRVAVPAARALVRAGTVVPTRRTSSTSGTSGVKCSAAVTPQASPVISRSAAAA

SEQ ID NO: 348 - protein, 72 aa, Unknown
  chloroplast transit peptide
MGAAATSMQSLKFSNRLVPPSRRLSPVPNNVTCNNLPKSAAPVRTVKCCASSWNSTINGAAATTNGASAASS

SEQ ID NO: 349 - protein, 20 aa, Unknown
  endosomal escape peptide
  SITE (4)..(4): Xaa is Lys, His or Arg
  SITE (8)..(8): Xaa is Lys, His or Arg
  SITE (11)..(11): Xaa is Lys, His or Arg
  SITE (15)..(15): Xaa is Lys, His or Arg
  SITE (19)..(19): Xaa is Lys, His or Arg
GLFXALLXLLXSLWXLLLXA

SEQ ID NO: 350 - protein, 20 aa, Unknown
  endosomal escape peptide
GLFHALLHLLHSLWHLLLHA

SEQ ID NO: 351 - protein, 9 aa, Unknown
  endosomal escape peptide
HHHHHHHHH

SEQ ID NO: 352 - protein, 7 aa, Betapolyomavirus macaca mulatta polyomavirus 1
PKKKRKV

SEQ ID NO: 353 - protein, 16 aa, Unknown
  nuclear localization signal
KRPAATKKAGQAKKKK

SEQ ID NO: 354 - protein, 9 aa, Homo sapiens
PAAKRVKLD

SEQ ID NO: 355 - protein, 11 aa, Homo sapiens
RQRRNELKRSP

SEQ ID NO: 356 - protein, 38 aa, Unknown
  nuclear localization signal
NQSSNFGPMKGGNFGGRSSGPYGGGGQYFAKPRNQGGY

SEQ ID NO: 357 - protein, 42 aa, Unknown
  nuclear localization signal
RMRIZFKNKGKDTAELRRRRVEVSVELRKAKKDEQILKRRNV

SEQ ID NO: 358 - protein, 8 aa, Unknown
  nuclear localization signal
VSRKRPRP

SEQ ID NO: 359 - protein, 8 aa, Unknown
  nuclear localization signal
PPKKARED

SEQ ID NO: 360 - protein, 8 aa, Homo sapiens
PQPKKKPL

SEQ ID NO: 361 - protein, 12 aa, Mus musculus
SALIKKKKKMAP

SEQ ID NO: 362 - protein, 5 aa, Alphainfluenzavirus influenza A virus
DRLRR

SEQ ID NO: 363 - protein, 7 aa, Alphainfluenzavirus influenza A virus
PKQKKRK

SEQ ID NO: 364 - protein, 10 aa, Deltavirus hepatitis delta virus
RKLKKKIKKL

SEQ ID NO: 365 - protein, 10 aa, Mus musculus
REKKKFLKRR

SEQ ID NO: 366 - protein, 20 aa, Homo sapiens
KRKGDEVDGVDEVAKKKSKK

SEQ ID NO: 367 - protein, 17 aa, Homo sapiens
RKCLQAGMNLEARKTKK

SEQ ID NO: 368 - protein, 8 aa, Orthobornavirus mammalian 1 orthobornavirus
PRPRKIPR

SEQ ID NO: 369 - protein, 9 aa, Hepacivirus  hepacivirus C
PPRKKRTVV

SEQ ID NO: 370 - protein, 12 aa, Unknown
  nuclear localization signal
NLSKKKKRKREK

SEQ ID NO: 371 - protein, 10 aa, Unknown
  nuclear localization signal
RRPSRPFRKP

SEQ ID NO: 372 - protein, 8 aa, Lymphocryptovirus human gammaherpesvirus 4
KRPRSPSS

SEQ ID NO: 373 - protein, 19 aa, Alphainfluenzavirus influenza A virus
KRGINDRNFWRGENERKTR

SEQ ID NO: 374 - protein, 11 aa, Homo sapiens
PRPPKMARYDN

SEQ ID NO: 375 - protein, 8 aa, Unknown
  nuclear localization signal
KRSFSKAF

SEQ ID NO: 376 - protein, 9 aa, Unknown
  nuclear localization signal
KLKIKRPVK

SEQ ID NO: 377 - protein, 19 aa, Unknown
  nuclear localization signal
PKKKRKVPPPPAAKRVKLD

SEQ ID NO: 378 - protein, 17 aa, Deltaretrovirus human T-lymphotropic virus 1
PKTRRRPRRSQRKRPPT

SEQ ID NO: 379 - protein, 24 aa, Caenorhabditis elegans
SRRRKANPTKLSENAKKLAKEVEN

SEQ ID NO: 380 - protein, 16 aa, Unknown
  nuclear localization signal
KTRRRPRRSQRKRPPT

SEQ ID NO: 381 - protein, 13 aa, Unknown
  nuclear localization signal
RRKKRRPRRKKRR

SEQ ID NO: 382 - protein, 14 aa, Unknown
  nuclear localization signal
PKKKSRKPKKKSRK

SEQ ID NO: 383 - protein, 17 aa, Unknown
  nuclear localization signal
HKKKHPDASVNFSEFSK

SEQ ID NO: 384 - protein, 18 aa, Unknown
  nuclear localization signal
QRPGPYDRPQRPGPYDRP

SEQ ID NO: 385 - protein, 16 aa, Unknown
  nuclear localization signal
LSPSLSPLLSPSLSPL

SEQ ID NO: 386 - protein, 18 aa, Unknown
  nuclear localization signal
RGKGGKGLGKGGAKRHRK

SEQ ID NO: 387 - protein, 14 aa, Unknown
  nuclear localization signal
PKRGRGRPKRGRGR

SEQ ID NO: 388 - protein, 19 aa, Unknown
  nuclear localization signal
PKKKRKVPPPPAAKRVKLD

SEQ ID NO: 389 - protein, 17 aa, Unknown
  nuclear localization signal
PKKKRKVPPPPKKKRKV

SEQ ID NO: 390 - protein, 11 aa, Lentivirus human immunodeficiency virus
YGRKKRRQRRR

SEQ ID NO: 391 - protein, 8 aa, Lentivirus human immunodeficiency virus
RKKRRQRR

SEQ ID NO: 392 - protein, 11 aa, Lentivirus human immunodeficiency virus
YARAAARQARA

SEQ ID NO: 393 - protein, 11 aa, Lentivirus human immunodeficiency virus
THRLPRRRRRR

SEQ ID NO: 394 - protein, 11 aa, Lentivirus human immunodeficiency virus
GGRRARRRRRR

SEQ ID NO: 395 - protein, 12 aa, Unknown
  peptide transduction domain
RRQRRTSKLMKR

SEQ ID NO: 396 - protein, 27 aa, Unknown
  peptide transduction domain
GWTLNSAGYLLGKINLKALAALAKKIL

SEQ ID NO: 397 - protein, 33 aa, Unknown
  peptide transduction domain
KALAWEAKLAKALAKALAKHLAKALAKALKCEA

SEQ ID NO: 398 - protein, 16 aa, Drosophila melanogaster
RQIKIWFQNRRMKWKK

SEQ ID NO: 399 - protein, 5 aa, Artificial Sequence
  linker polypeptide
GSGGS

SEQ ID NO: 400 - protein, 6 aa, Artificial Sequence
  linker polypeptide
GGSGGS

SEQ ID NO: 401 - protein, 4 aa, Artificial Sequence
  linker polypeptide
GGGS

SEQ ID NO: 402 - protein, 4 aa, Artificial Sequence
  linker polypeptide
GGSG

SEQ ID NO: 403 - protein, 5 aa, Artificial Sequence
  linker polypeptide
GGSGG

SEQ ID NO: 404 - protein, 5 aa, Artificial Sequence
  linker polypeptide
GSGSG

SEQ ID NO: 405 - protein, 5 aa, Artificial Sequence
  linker polypeptide
GSGGG

SEQ ID NO: 406 - protein, 5 aa, Artificial Sequence
  linker polypeptide
GGGSG

SEQ ID NO: 407 - protein, 5 aa, Artificial Sequence
  linker polypeptide
GSSSG

SEQ ID NO: 408 - protein, 4 aa, Artificial Sequence
  linker polypeptide
GPGP

SEQ ID NO: 409 - protein, 6 aa, Artificial Sequence
  linker polypeptide
PPAPPA

SEQ ID NO: 410 - protein, 7 aa, Artificial Sequence
  linker polypeptide
PPPGPPP

SEQ ID NO: 411 - protein, 25 aa, Unknown
  nuclear localization signal
MSRRRKANPTKLSENAKKLAKEVEN

SEQ ID NO: 412 - DNA, 108 bp, Artificial Sequence
  scaffold variant
tactggcgcttttatctcattactttcgagagccatcaccagcgactatgtcgtatgggtaaagcgcttatttatcgagagaaatccgataaataagaagcatcaaag

SEQ ID NO: 413 - DNA, 110 bp, Artificial Sequence
  scaffold variant
tactggcgcttttatctcattactttcgagagccatcaccagcgactatgtcgtatgggtaaagcgcttatttatccggagagaaatccgataaataagaagcatcaaag

SEQ ID NO: 414 - DNA, 108 bp, Artificial Sequence
  scaffold variant
cctggcgcttttatctcattactttcgagagccatcaccagcgactatgtcgtatgggtaaagcgcttatttatcggagagaaatccgataaataagaagcatcaaag

SEQ ID NO: 415 - DNA, 108 bp, Artificial Sequence
  scaffold variant
cctggcgcttttatctcattactttgagagccatcaccagcgactatgtcgtagtgggtaaagcgcttatttatcggagagaaatccgataaataagaagcatcaaag

SEQ ID NO: 416 - DNA, 106 bp, Artificial Sequence
  scaffold variant
cctggcgcttttatctcattactttgagagccatcaccagcgactatgtcgtatgggtaaagcgcttatttatcaagagaaatccgataaataagaagcatcaaag

SEQ ID NO: 417 - DNA, 108 bp, Artificial Sequence
  scaffold variant
cctggcgcttttatctcattactttgagagccatcaccagcgactatgtcgtattgggtaaagcgcttatttatcggagagaaatccgataaataagaagcatcaaag

SEQ ID NO: 418 - DNA, 108 bp, Artificial Sequence
  scaffold variant
tactggcgcttttatctcattactttcgagagccatcaccagcgactatgtcgtatgggtaaagcgcttatttatcggagagaaatcgataaataagaagcatcaaag

SEQ ID NO: 419 - DNA, 108 bp, Artificial Sequence
  scaffold variant
cctggcgcttttatctcattactttgagagccatcaccagcgactatgtcgtatgggtaaagcgcttatttatgcggagagaaatccgataaataagaagcatcaaag

SEQ ID NO: 420 - DNA, 108 bp, Artificial Sequence
  scaffold variant
cctggcgcttttatctcattactttgagagccatcaccagcgactatgtcgtatgggtaaagcgcttatttatctggagagaaatccgataaataagaagcatcaaag

SEQ ID NO: 421 - DNA, 108 bp, Artificial Sequence
  scaffold variant
cctggcgcttttatctcattactttgagagccatcaccagcgactatgtcgtatgggtaaagcgcttatttatcggagagaaatctcgataaataagaagcatcaaag

SEQ ID NO: 422 - DNA, 108 bp, Artificial Sequence
  scaffold variant
cctggcgcttttatctcattactttgagagccatcaccagcgactatgtcgtatgggtaaagcgcttatttatccggagagaaatccgataaataagaagcatcaaag

SEQ ID NO: 423 - DNA, 108 bp, Artificial Sequence
  scaffold variant
cctggcgcttttatctcattactttagagagccatcaccagcgactatgtcgtatgggtaaagcgcttatttatcggagagaaatccgataaataagaagcatcaaag

SEQ ID NO: 424 - DNA, 105 bp, Artificial Sequence
  scaffold variant
ctggcgcttttatctcattactttgagagccatcaccagcgactatgtcgtatgggtaaagcgcttatttatcgagagaaatccgataaataagaagcatcaaag

SEQ ID NO: 425 - DNA, 110 bp, Artificial Sequence
  scaffold variant
tactggcgcttttattctcattactttgagagccatcaccagcgactatgtcgtatgggtaaagcgcttatttattcggagagaaatccgataaataagaagcatcaaag

SEQ ID NO: 426 - DNA, 108 bp, Artificial Sequence
  scaffold variant
tactggcgcttttatctcattactttgtagagccatcaccagcgactatgtcgtatgggtaaagcgcttatttatctagagaaatccgataaataagaagcatcaaag

SEQ ID NO: 427 - DNA, 108 bp, Artificial Sequence
  scaffold variant
cctggcgcttttatctcattactttgagagccatcaccagcgactatgtcgtatgggtaaagcgcttatttatcggagagaaatcccgataaataagaagcatcaaag

SEQ ID NO: 428 - DNA, 108 bp, Artificial Sequence
  scaffold variant
tactggcgcttttatctcattactttcgagagccatcaccagcgactatgtcgtatgggtaaagcgcttatttattgagagaaatccgataaataagaagcatcaaag

SEQ ID NO: 429 - DNA, 107 bp, Artificial Sequence
  scaffold variant
ctggcgcttttatctcattactttgagagccatcaccagcgactatgtcgtagtgggtaaagcgcttatttatcggagagaaatccgataaataagaagcatcaaag

SEQ ID NO: 430 - DNA, 106 bp, Artificial Sequence
  scaffold variant
cctggcgcttttatctcattactttgagagccatcaccagcgactatgtcgtatgggtaaagcgcttatttatcgagagaaatccgataaataagaagcatcaaag

SEQ ID NO: 431 - DNA, 107 bp, Artificial Sequence
  scaffold variant
ctggcgcttttatctcattactttgagagccatcaccagcgactatgtcgtatgggtaaagcgcttatttatccggagagaaatccgataaataagaagcatcaaag

SEQ ID NO: 432 - DNA, 108 bp, Artificial Sequence
  scaffold variant
actggcgcttttatctcattactttgagagccatcaccagcgactatgtcgtagtgggtaaagcgcttatttatcggagagaaatccgataaataagaagcatcaaag

SEQ ID NO: 433 - DNA, 106 bp, Artificial Sequence
  scaffold variant
cctggcgcttttatctcattactttgagagccatcaccagcgactatgtcgtatgggtaaagcgcttatttatcggagataatccgataaataagaagcatcaaag

SEQ ID NO: 434 - DNA, 108 bp, Artificial Sequence
  scaffold variant
cctggcgcttttatctcattactttgagagccatcaccagcgactatgtcgtatgggtaaagcgcttatttatcggagagaaatcgcgataaataagaagcatcaaag

SEQ ID NO: 435 - DNA, 105 bp, Artificial Sequence
  scaffold variant
cctggcgcttttatctcattactttgagagccatcaccagcgactatgtcgtatgggtaaagcgcttatttatcggagaaatccgataaataagaagcatcaaag

SEQ ID NO: 436 - DNA, 110 bp, Artificial Sequence
  scaffold variant
tactggcgcttttatctcattactttcgagagccatcaccagcgactatgtcgtatgggtaaagcgcttatttatcaggagagaaatccgataaataagaagcatcaaag

SEQ ID NO: 437 - DNA, 110 bp, Artificial Sequence
  scaffold variant
tactggcgcttttattctcattactttgagagccatcaccagcgactatgtcgtatgggtaaagcgcttatttatgcggagagaaatccgataaataagaagcatcaaag

SEQ ID NO: 438 - DNA, 110 bp, Artificial Sequence
  scaffold variant
tactggcgcttttatctcattactttagagagccatcaccagcgactatgtcgtatgggtaaagcgcttatttatccggagagaaatccgataaataagaagcatcaaag

SEQ ID NO: 439 - DNA, 108 bp, Artificial Sequence
  scaffold variant
cctggcgcttttatctcattactttgagagccatcaccagcgactatgtcgtatgggtaaagcgcttatttatcggcagagaaatccgataaataagaagcatcaaag

SEQ ID NO: 440 - DNA, 108 bp, Artificial Sequence
  scaffold variant
actggcgcttttatctcattactttgagagccatcaccagcgactatgtcgtatgggtaaagcgcttatttatcggagagaaatcccgataaataagaagcatcaaag

SEQ ID NO: 441 - DNA, 106 bp, Artificial Sequence
  scaffold variant
actggcgcttttatctcattactttgagagccatcaccagcgactatgtcgtatgggtaaagcgcttatttatccagagaaatccgataaataagaagcatcaaag

SEQ ID NO: 442 - DNA, 110 bp, Artificial Sequence
  scaffold variant
tactggcgcttttatctcattactttcgagagccatcaccagcgactatgtcgtatgggtaaagcgcttatttatcgggagagaaatccgataaataagaagcatcaaag

SEQ ID NO: 443 - DNA, 108 bp, Artificial Sequence
  scaffold variant
tactggcgcttttatcttcattactttgagagccatcaccagcgactatgtcgtatgggtaaagcgcttatttatcaagagaaatccgataaataagaagcatcaaag

SEQ ID NO: 444 - DNA, 108 bp, Artificial Sequence
  scaffold variant
actggcgcttttatctcattactttgagagccatcaccagcgactatgtcgtatgggtaaagcgcttatttattcggagagaaatccgataaataagaagcatcaaag

SEQ ID NO: 445 - DNA, 106 bp, Artificial Sequence
  scaffold variant
cctggcgcttttatctcattactttgagagccatcaccagcgactatgtcgtatgggtaaagcgcttatttatcggagagaaaccgataaataagaagcatcaaag

SEQ ID NO: 446 - DNA, 106 bp, Artificial Sequence
  scaffold variant
actggcgcttttatctcattactttgagagccatcaccagcgactatgtcgtatgggtaaagcgcttatttatcgagagaaatccgataaataagaagcatcaaag

SEQ ID NO: 447 - DNA, 107 bp, Artificial Sequence
  scaffold variant
tactggcgcttttatctcattactttcgagagccatcaccagcgactatgtcgtatgggtaaagcgcttatttatcggagaaatccgataaataagaagcatcaaag

SEQ ID NO: 448 - DNA, 106 bp, Artificial Sequence
  scaffold variant
cctggcgcttttatctcattactttgagagccatcaccagcgactatgtcgtatgggtaaagcgcttatttatccagagaaatccgataaataagaagcatcaaag

SEQ ID NO: 449 - DNA, 108 bp, Artificial Sequence
  scaffold variant
cctggcgcttttatctcattactttgagagccatcaccagcgactatgtcgtatgggtaaagcgcttatttattcggagagaaatccgataaataagaagcatcaaag

SEQ ID NO: 450 - DNA, 108 bp, Artificial Sequence
  scaffold variant
cctggcgcttttatctcattactttgagagccatcaccagcgactatgtcgtatgggtaaagcgcttatttatcgggagagaaatccgataaataagaagcatcaaag

SEQ ID NO: 451 - DNA, 106 bp, Artificial Sequence
  scaffold variant
actggcgcttttatctcattactttgagagccatcaccagcgactatgtcgtatgggtaaagcgcttatttatcggagataatccgataaataagaagcatcaaag

SEQ ID NO: 452 - DNA, 108 bp, Artificial Sequence
  scaffold variant
actggcgcttttatctcattactttgagagccatcaccagcgactatgtcgtatgggtaaagcgcttatttatcggagagaaatccgcataaataagaagcatcaaag

SEQ ID NO: 453 - DNA, 105 bp, Artificial Sequence
  scaffold variant
ctggcgcttttatctcattactttgagagccatcaccagcgactatgtcgtatgggtaaagcgcttatttatcaagagaaatccgataaataagaagcatcaaag

SEQ ID NO: 454 - DNA, 106 bp, Artificial Sequence
  scaffold variant
actggcgcttttatctcattactttgagagccatcaccagcgactatgtcgtatgggtaaagcgcttatttatcaagagaaatccgataaataagaagcatcaaag

SEQ ID NO: 455 - DNA, 108 bp, Artificial Sequence
  scaffold variant
actggcgcttttatctcattactttgagagccatcaccagcgactatgtcgtatgggtaaagcgcttatttatccggagagaaatccgataaataagaagcatcaaag

SEQ ID NO: 456 - DNA, 106 bp, Artificial Sequence
  scaffold variant
tctggcgcttttatctcattactttgagagccatcaccagcgactatgtcgtatgggtaaagcgcttatttatcggagataatccgataaataagaagcatcaaag

SEQ ID NO: 457 - DNA, 108 bp, Artificial Sequence
  scaffold variant
tactggcgcttttatctcattactttcgagagccatcaccagcgactatgtcgtatgggtaaagcgcttatttatctagagaaatccgataaataagaagcatcaaag

SEQ ID NO: 458 - DNA, 110 bp, Artificial Sequence
  scaffold variant
tactggcgcttttattctcattactttgagagccatcaccagcgactatgtcgtatgggtaaagcgcttatttatccggagagaaatccgataaataagaagcatcaaag

SEQ ID NO: 459 - DNA, 110 bp, Artificial Sequence
  scaffold variant
tactggcgcttttatctcattactttcgagagccatcaccagcgactatgtcgtatgggtaaagcgcttatttattcggagagaaatccgataaataagaagcatcaaag

SEQ ID NO: 460 - DNA, 108 bp, Artificial Sequence
  scaffold variant
tacggcgcttttatctcattactttgagagccatcaccagcgactatgtcgtatgggtaaagcgcttatttatctggagagaaatccgataaataagaagcatcaaag

SEQ ID NO: 461 - DNA, 106 bp, Artificial Sequence
  scaffold variant
cctggcgcttttatctcattactttgagagccatcaccagcgactatgtcgtatgggtaaagcgcttattttcggagagaaatccgataaataagaagcatcaaag

SEQ ID NO: 462 - DNA, 108 bp, Artificial Sequence
  scaffold variant
tactggcgcttttatctcattactttcgagagccatcaccagcgactatgtcgtatgggtaaagcgcttatttatcgggagaaatccgataaataagaagcatcaaag

SEQ ID NO: 463 - DNA, 106 bp, Artificial Sequence
  scaffold variant
tacggcgcttttatctcattactttgagagccatcaccagcgactatgtcgtatgggtaaagcgcttatttatctagagaaatccgataaataagaagcatcaaag

SEQ ID NO: 464 - DNA, 108 bp, Artificial Sequence
  scaffold variant
tacggcgcttttatctcattactttgagagccatcaccagcgactatgtcgtatgggtaaagcgcttatttatcggagagaaatctcgataaataagaagcatcaaag

SEQ ID NO: 465 - DNA, 108 bp, Artificial Sequence
  scaffold variant
cctggcgcttttatctcattactttgagagccatcaccagcgactatgtcgtatgggtaaagcgcttatttactcggagagaaatccgataaataagaagcatcaaag

SEQ ID NO: 466 - DNA, 105 bp, Artificial Sequence
  scaffold variant
atggcgcttttatctcattactttgagagccatcaccagcgactatgtcgtatgggtaaagcgcttatttatcgagagaaatccgataaataagaagcatcaaag

SEQ ID NO: 467 - DNA, 108 bp, Artificial Sequence
  scaffold variant
tactggcgcttttatcttcattactttgagagccatcaccagcgactatgtcgtatgggtaaagcgcttatttatcgagagaaatccgataaataagaagcatcaaag

SEQ ID NO: 468 - DNA, 106 bp, Artificial Sequence
  scaffold variant
cctggcgcttttatctcattactttgagagccatcaccagcgactatgtcgtatgggtaaagcgcttatttatcgtgagaaatccgataaataagaagcatcaaag

SEQ ID NO: 469 - DNA, 108 bp, Artificial Sequence
  scaffold variant
actggcgcttttatctcattactttgagagccatcaccagcgactatgtcgtatgggtaaagcgcttatttatcggagagaaatctcgataaataagaagcatcaaag

SEQ ID NO: 470 - DNA, 106 bp, Artificial Sequence
  scaffold variant
cctggcgcttttatctcattactttgagagccatcaccagcgactatgtcgtatgggtaaagcgcttatttatcggagagaaatccataaataagaagcatcaaag

SEQ ID NO: 471 - DNA, 108 bp, Artificial Sequence
  scaffold variant
gctggcgcttttatctcattactttcgagagccatcaccagcgactatgtcgtatgggtaaagcgcttatttatcggagagaaatccgataaataagaagcatcaaag

SEQ ID NO: 472 - DNA, 121 bp, Artificial Sequence
  scaffold variant
tactggcgcttttatctcattactttgctcattactttgagagccatcaccagcgactatgtcgtatgggtaaagcgcttatttatgcggagagaaatccgataaataagaagcatcaaag

SEQ ID NO: 473 - DNA, 105 bp, Artificial Sequence
  scaffold variant
ctggcgcttttatctcattactttgagagccatcaccagcgactatgtcgtatgggtaaagcgcttatttatcgggagaaatccgataaataagaagcatcaaag

SEQ ID NO: 474 - DNA, 106 bp, Artificial Sequence
  scaffold variant
cctggcgcttttatctcattactttgagagccatcaccagcgactatgtcgtatgggtaaagcgcttatttatctagagaaatccgataaataagaagcatcaaag

SEQ ID NO: 475 - DNA, 106 bp, Artificial Sequence
  scaffold variant
actggcgcttttatctcattactttgagagccatcaccagcgactatgtcgtatgggtaaagcgcttatttattgagagaaatccgataaataagaagcatcaaag

SEQ ID NO: 476 - DNA, 106 bp, Artificial Sequence
  scaffold variant
actggcgcttttatctcattactttgagagccatcaccagcgactatgtcgtatgggtaaagcgcttatttatcggagagaaatcgataaataagaagcatcaaag

SEQ ID NO: 477 - DNA, 108 bp, Artificial Sequence
  scaffold variant
actggcgcttttatctcattactttgagagccatcaccagcgactatgtcgtatgggtaaagcgcttatttatcgcgagagaaatccgataaataagaagcatcaaag

SEQ ID NO: 478 - DNA, 108 bp, Artificial Sequence
  scaffold variant
actggcgcttttatctcattactttgagagccatcaccagcgactatgtcgtatgggtaaagcgcttattctatcggagagaaatccgataaataagaagcatcaaag

SEQ ID NO: 479 - DNA, 108 bp, Artificial Sequence
  scaffold variant
tctggcgcttttatctcattactttgagagccatcaccagcgactatgtcgtagtgggtaaagcgcttatttatcggagagaaatccgataaataagaagcatcaaag

SEQ ID NO: 480 - DNA, 108 bp, Artificial Sequence
  scaffold variant
tactggcgcttttatctcattactttgcagagccatcaccagcgactatgtcgtatgggtaaagcgcttatttatccagagaaatccgataaataagaagcatcaaag

SEQ ID NO: 481 - DNA, 106 bp, Artificial Sequence
  scaffold variant
cctggcgcttttatctcattactttgagagccatcaccagcgactatgtcgtatgggtaaagcgcttatttccggagagaaatccgataaataagaagcatcaaag

SEQ ID NO: 482 - DNA, 106 bp, Artificial Sequence
  scaffold variant
tctggcgcttttatctcattactttgagagccatcaccagcgactatgtcgtatgggtaaagcgcttatttatcaagagaaatccgataaataagaagcatcaaag

SEQ ID NO: 483 - DNA, 110 bp, Artificial Sequence
  scaffold variant
tactggcgcttttatcttcattactttgagagccatcaccagcgactatgtcgtatgggtaaagcgcttatttatcggcagagaaatccgataaataagaagcatcaaag

SEQ ID NO: 484 - DNA, 107 bp, Artificial Sequence
  scaffold variant
ctggcgcttttatctcattactttgagagccatcaccagcgactatgtcgtatgggtaaagcgcttatttatgcggagagaaatccgataaataagaagcatcaaag

SEQ ID NO: 485 - DNA, 108 bp, Artificial Sequence
  scaffold variant
tctggcgcttttatctcattactttagagagccatcaccagcgactatgtcgtatgggtaaagcgcttatttatcggagagaaatccgataaataagaagcatcaaag

SEQ ID NO: 486 - DNA, 110 bp, Artificial Sequence
  scaffold variant
tactggcgcttttattctcattactttgagagccatcaccagcgactatgtcgtatgggtaaagcgcttatttatcggagagaaataccgataaataagaagcatcaaag

SEQ ID NO: 487 - DNA, 108 bp, Artificial Sequence
  scaffold variant
tctggcgcttttatctcattactttgagagccatcaccagcgactatgtcgtatgggtaaagcgcttatttatgcggagagaaatccgataaataagaagcatcaaag

SEQ ID NO: 488 - DNA, 108 bp, Artificial Sequence
  scaffold variant
tactggcgcttttatctcattactttgtagagccatcaccagcgactatgtcgtatgggtaaagcgcttatttatcaagagaaatccgataaataagaagcatcaaag

SEQ ID NO: 489 - DNA, 106 bp, Artificial Sequence
  scaffold variant
tacggcgcttttatctcattactttgagagccatcaccagcgactatgtcgtatgggtaaagcgcttatttattgagagaaatccgataaataagaagcatcaaag

SEQ ID NO: 490 - DNA, 108 bp, Artificial Sequence
  scaffold variant
tacggcgcttttatctcattactttgagagccatcaccagcgactatgtcgtatgggtaaagcgcttatttatccggagagaaatccgataaataagaagcatcaaag

SEQ ID NO: 491 - DNA, 108 bp, Artificial Sequence
  scaffold variant
cctggcgcttttatctcattactttgagagccatcaccagcgactatgtcgtatgggtaaagcgcttatttatcggagagaaatcctgataaataagaagcatcaaag

SEQ ID NO: 492 - DNA, 108 bp, Artificial Sequence
  scaffold variant
actggcgcttttatctcattactttgagagccatcaccagcgactatgtcgtatgggtaaagcgcttatttatacggagagaaatccgataaataagaagcatcaaag

SEQ ID NO: 493 - DNA, 107 bp, Artificial Sequence
  scaffold variant
atggcgcttttatctcattactttgagagccatcaccagcgactatgtcgtatgggtaaagcgcttatttatgcggagagaaatccgataaataagaagcatcaaag

SEQ ID NO: 494 - DNA, 108 bp, Artificial Sequence
  scaffold variant
tctggcgcttttatctcattactttgcagagccatcaccagcgactatgtcgtatgggtaaagcgcttatttatcggagagaaatccgataaataagaagcatcaaag

SEQ ID NO: 495 - DNA, 107 bp, Artificial Sequence; identical to SEQ ID NO: 431
  scaffold variant

SEQ ID NO: 496 - DNA, 108 bp, Artificial Sequence
  scaffold variant
gctggcgcttttatctcattactttgagagccatcaccagcgactatgtcgtagtgggtaaagcgcttatttatcggagagaaatccgataaataagaagcatcaaag

SEQ ID NO: 497 - DNA, 110 bp, Artificial Sequence
  scaffold variant
tactggcgcttttattctcattactttgagagccatcaccagcgactatgtcgtatgggtaaagcgcttatttactcggagagaaatccgataaataagaagcatcaaag

SEQ ID NO: 498 - DNA, 110 bp, Artificial Sequence
  scaffold variant
tactggcgcttttatctctattactttgagagccatcaccagcgactatgtcgtatgggtaaagcgcttatttatgcggagagaaatccgataaataagaagcatcaaag

SEQ ID NO: 499 - DNA, 108 bp, Artificial Sequence
  scaffold variant
tacggcgcttttatctcattactttgagagccatcaccagcgactatgtcgtatgggtaaagcgcttatttatcggagagaaatcgcgataaataagaagcatcaaag

SEQ ID NO: 500 - DNA, 105 bp, Artificial Sequence
  scaffold variant
atggcgcttttatctcattactttgagagccatcaccagcgactatgtcgtatgggtaaagcgcttatttatcgggagaaatccgataaataagaagcatcaaag

SEQ ID NO: 501 - DNA, 108 bp, Artificial Sequence
  scaffold variant
cctggcgcttttatctcattactttgagagccatcaccagcgactatgtcgtatgggtaaagcgcttatttatcggagagaaatccgcataaataagaagcatcaaag

SEQ ID NO: 502 - DNA, 108 bp, Artificial Sequence
  scaffold variant
cctggcgcttttatctcattactttgagagccatcaccagcgactatgtcgtatgggtaaagcgcttatttatcggagagaaatccgaataaataagaagcatcaaag

SEQ ID NO: 503 - DNA, 110 bp, Artificial Sequence
  scaffold variant
tactggcgcttttattctcattactttgagagccatcaccagcgactatgtcgtatgggtaaagcgcttatttagtcggagagaaatccgataaataagaagcatcaaag

SEQ ID NO: 504 - DNA, 106 bp, Artificial Sequence
  scaffold variant
tctggcgcttttatctcattactttgagagccatcaccagcgactatgtcgtatgggtaaagcgcttatttatcgagagaaatccgataaataagaagcatcaaag

SEQ ID NO: 505 - DNA, 108 bp, Artificial Sequence
  scaffold variant
tactggcgcttttatcttcattactttgagagccatcaccagcgactatgtcgtatgggtaaagcgcttatttatctagagaaatccgataaataagaagcatcaaag

SEQ ID NO: 506 - DNA, 108 bp, Artificial Sequence
  scaffold variant
actggcgcttttatctcattactttgagagccatcaccagcgactatgtcgtatgggtaaagcgcttatttatcgtgagagaaatccgataaataagaagcatcaaag

SEQ ID NO: 507 - DNA, 108 bp, Artificial Sequence
  scaffold variant
cctggcgcttttatctcattactttgagagccatcaccagcgactatgtcgtatgggtaaagcgcttatttatcggagagaaatccgtataaataagaagcatcaaag

SEQ ID NO: 508 - DNA, 106 bp, Artificial Sequence
  scaffold variant
cctggcgcttttatctcattactttgagagccatcaccagcgactatgtcgtatgggtaaagcgcttatttattgagagaaatccgataaataagaagcatcaaag

SEQ ID NO: 509 - DNA, 108 bp, Artificial Sequence
  scaffold variant
cctggcgcttttatctcattactttgagagccatcaccagcgactatgtcgtatgggtaaagcgcttatttatcggagagaaataccgataaataagaagcatcaaag

SEQ ID NO: 510 - DNA, 108 bp, Artificial Sequence
  scaffold variant
tctggcgcttttatctcattactttcgagagccatcaccagcgactatgtcgtatgggtaaagcgcttatttatcggagagaaatccgataaataagaagcatcaaag

SEQ ID NO: 511 - DNA, 108 bp, Artificial Sequence
  scaffold variant
cctggcgcttttatcttcattactttgagagccatcaccagcgactatgtcgtatgggtaaagcgcttatttatcggagagaaatccgataaataagaagcatcaaag

SEQ ID NO: 512 - DNA, 107 bp, Artificial Sequence
  scaffold variant
ctggcgcttttatctcattactttgagagccatcaccagcgactatgtcgtatgggtaaagcgcttatttatctggagagaaatccgataaataagaagcatcaaag

SEQ ID NO: 513 - DNA, 108 bp, Artificial Sequence
  scaffold variant
actggcgcttttatctcattactttgagagccatcaccagcgactatgtcgtatgggtaaagcgcttatttatcggcagagaaatccgataaataagaagcatcaaag

SEQ ID NO: 514 - DNA, 106 bp, Artificial Sequence
  scaffold variant
cctggcgcttttatctcattactttgagagccatcaccagcgactatgtcgtatgggtaaagcgcttatttatcggaggaaatccgataaataagaagcatcaaag

SEQ ID NO: 515 - DNA, 106 bp, Artificial Sequence
  scaffold variant
cctggcgcttttatctcattactttgagagccatcaccagcgactatgtcgtatgggtaaagcgcttatttatcggagagaaatccgtaaataagaagcatcaaag

SEQ ID NO: 516 - DNA, 108 bp, Artificial Sequence
  scaffold variant
tctggcgcttttatctcattactttgagagccatcaccagcgactatgtcgtatgggtaaagcgcttatttatcggagagaaatcacgataaataagaagcatcaaag

SEQ ID NO: 517 - DNA, 108 bp, Artificial Sequence
  scaffold variant
tacggcgcttttatctcattactttgagagccatcaccagcgactatgtcgtatgggtaaagcgcttatttatcggagagaaatcctgataaataagaagcatcaaag

SEQ ID NO: 518 - DNA, 108 bp, Artificial Sequence
  scaffold variant
actggcgcttttatctcattactttgagagccatcaccagcgactatgtcgtatgggtaaagcgcttatttatgcggagagaaatccgataaataagaagcatcaaag

SEQ ID NO: 519 - DNA, 108 bp, Artificial Sequence
  scaffold variant
cctggcgcttttatctcattactttgagagccatcaccagcgactatgtcgtatgggtaaagcgcttatttagtcggagagaaatccgataaataagaagcatcaaag

SEQ ID NO: 520 - DNA, 107 bp, Artificial Sequence
  scaffold variant
ctggcgcttttatctcattactttgagagccatcaccagcgactatgtcgtatgggtaaagcgcttatttatcggagagaaatcccgataaataagaagcatcaaag

SEQ ID NO: 521 - DNA, 110 bp, Artificial Sequence
  scaffold variant
tactggcgcttttatcttcattactttgagagccatcaccagcgactatgtcgtatgggtaaagcgcttatttattcggagagaaatccgataaataagaagcatcaaag

SEQ ID NO: 522 - DNA, 110 bp, Artificial Sequence
  scaffold variant
tactggcgcttttatctctattactttgagagccatcaccagcgactatgtcgtatgggtaaagcgcttatttatcggagagaaatcgcgataaataagaagcatcaaag

SEQ ID NO: 523 - DNA, 105 bp, Artificial Sequence
  scaffold variant
ctggcgcttttatctcattactttgagagccatcaccagcgactatgtcgtatgggtaaagcgcttatttatctagagaaatccgataaataagaagcatcaaag

SEQ ID NO: 524 - DNA, 110 bp, Artificial Sequence
  scaffold variant
tactggcgcttttatctcattactttcgagagccatcaccagcgactatgtcgtatgggtaaagcgcttatttatcggagagaaatcccgataaataagaagcatcaaag

SEQ ID NO: 525 - DNA, 108 bp, Artificial Sequence
  scaffold variant
tactggcgcttttatctcattactttcgagagccatcaccagcgactatgtcgtatgggtaaagcgcttatttccggagagaaatccgataaataagaagcatcaaag

SEQ ID NO: 526 - DNA, 108 bp, Artificial Sequence
  scaffold variant
actggcgcttttatctcattactttgagagccatcaccagcgactatgtcgtatgggtaaagcgcttatttatcggagagaaatcacgataaataagaagcatcaaag

SEQ ID NO: 527 - DNA, 108 bp, Artificial Sequence
  scaffold variant
cctggcgcttttatctcattactttgagagccatcaccagcgactatgtcgtatgggtaaagcgcttatttatcgtgagagaaatccgataaataagaagcatcaaag

SEQ ID NO: 528 - DNA, 107 bp, Artificial Sequence
  scaffold variant
ctggcgcttttatctcattactttgagagccatcaccagcgactatgtcgtatgggtaaagcgcttatttatcggagagaaatcgcgataaataagaagcatcaaag

SEQ ID NO: 529 - DNA, 106 bp, Artificial Sequence
  scaffold variant
tacggcgcttttatctcattactttgagagccatcaccagcgactatgtcgtatgggtaaagcgcttatttatcgggagaaatccgataaataagaagcatcaaag

SEQ ID NO: 530 - DNA, 110 bp, Artificial Sequence
  scaffold variant
tactggcgcttttatcttcattactttgagagccatcaccagcgactatgtcgtatgggtaaagcgcttatttatgcggagagaaatccgataaataagaagcatcaaag

SEQ ID NO: 531 - DNA, 108 bp, Artificial Sequence
  scaffold variant
tctggcgcttttatctcattactttgagagccatcaccagcgactatgtcgtatgggtaaagcgcttatttatcggagagaaatcgcgataaataagaagcatcaaag

SEQ ID NO: 532 - DNA, 106 bp, Artificial Sequence
  scaffold variant
tctggcgcttttatctcattactttgagagccatcaccagcgactatgtcgtatgggtaaagcgcttatttatctagagaaatccgataaataagaagcatcaaag

SEQ ID NO: 533 - DNA, 110 bp, Artificial Sequence
  scaffold variant
tactggcgcttttatcctcattactttgagagccatcaccagcgactatgtcgtatgggtaaagcgcttatttatgcggagagaaatccgataaataagaagcatcaaag

SEQ ID NO: 534 - DNA, 106 bp, Artificial Sequence
  scaffold variant
tacggcgcttttatctcattactttgagagccatcaccagcgactatgtcgtatgggtaaagcgcttatttatcggagagaaatcgataaataagaagcatcaaag

SEQ ID NO: 535 - DNA, 108 bp, Artificial Sequence
  scaffold variant
tctggcgcttttatctcattactttgagagccatcaccagcgactatgtcgtatgggtaaagcgcttatttattcggagagaaatccgataaataagaagcatcaaag

SEQ ID NO: 536 - DNA, 106 bp, Artificial Sequence
  scaffold variant
tctggcgcttttatctcattactttgagagccatcaccagcgactatgtcgtatgggtaaagcgcttatttatcggagagaaatcgataaataagaagcatcaaag

SEQ ID NO: 537 - DNA, 107 bp, Artificial Sequence
  scaffold variant
tcggcgcttttatctcattactttgagagccatcaccagcgactatgtcgtatgggtaaagcgcttatttatcggagagaaatcccgataaataagaagcatcaaag

SEQ ID NO: 538 - DNA, 108 bp, Artificial Sequence
  scaffold variant
actggcgcttttatctcattactttgagagccatcaccagcgactatgtcgtatgggtaaagcgcttatttatcggagagaaatcgcgataaataagaagcatcaaag

SEQ ID NO: 539 - DNA, 106 bp, Artificial Sequence
  scaffold variant
cctggcgcttttatctcattactttgagagccatcaccagcgactatgtcgtatgggtaaagcgcttatttacggagagaaatccgataaataagaagcatcaaag

SEQ ID NO: 540 - DNA, 110 bp, Artificial Sequence
  scaffold variant
tactggcgcttttattctcattactttgagagccatcaccagcgactatgtcgtatgggtaaagcgcttatttatcggagagaaatcacgataaataagaagcatcaaag

SEQ ID NO: 541 - DNA, 106 bp, Artificial Sequence
  scaffold variant
cctggcgcttttatctcattactttgagagccatcaccagcgactatgtcgtatgggtaaagcgcttatttatcggaagaaatccgataaataagaagcatcaaag

SEQ ID NO: 542 - DNA, 110 bp, Artificial Sequence
  scaffold variant
tactggcgcttttatctcattactttgagagccatcaccagcgactatgtcgtatgggtaaagcgcttatttatgcggagagaaatcccgataaataagaagcatcaaag

SEQ ID NO: 543 - DNA, 106 bp, Artificial Sequence
  scaffold variant
actggcgcttttatctcattactttgagagccatcaccagcgactatgtcgtatgggtaaagcgcttatttatctagagaaatccgataaataagaagcatcaaag

SEQ ID NO: 544 - DNA, 108 bp, Artificial Sequence
  scaffold variant
tacggcgcttttatctcattactttgagagccatcaccagcgactatgtcgtatgggtaaagcgcttatttatcggagagaaatcccgataaataagaagcatcaaag

SEQ ID NO: 545 - DNA, 110 bp, Artificial Sequence
  scaffold variant
tactggcgcttttattctcattactttgagagccatcaccagcgactatgtcgtatgggtaaagcgcttatttatcggagagaaatcgcgataaataagaagcatcaaag

SEQ ID NO: 546 - DNA, 108 bp, Artificial Sequence
  scaffold variant
tctggcgcttttatctcattactttgagagccatcaccagcgactatgtcgtatgggtaaagcgcttatttatcggagagaaatctcgataaataagaagcatcaaag

SEQ ID NO: 547 - DNA, 107 bp, Artificial Sequence
  scaffold variant
atggcgcttttatctcattactttgagagccatcaccagcgactatgtcgtatgggtaaagcgcttatttatcgggagagaaatccgataaataagaagcatcaaag

SEQ ID NO: 548 - DNA, 105 bp, Artificial Sequence
  scaffold variant
ctggcgcttttatctcattactttgagagccatcaccagcgactatgtcgtatgggtaaagcgcttatttattgagagaaatccgataaataagaagcatcaaag

SEQ ID NO: 549 - DNA, 110 bp, Artificial Sequence
  scaffold variant
tactggcgcttttattctcattactttgagagccatcaccagcgactatgtcgtatgggtaaagcgcttatttatacggagagaaatccgataaataagaagcatcaaag

SEQ ID NO: 550 - DNA, 110 bp, Artificial Sequence
  scaffold variant
tactggcgcttttatcttcattactttgagagccatcaccagcgactatgtcgtatgggtaaagcgcttatttatcggagagaaatctcgataaataagaagcatcaaag

SEQ ID NO: 551 - DNA, 105 bp, Artificial Sequence
  scaffold variant
ctggcgcttttatctcattactttgagagccatcaccagcgactatgtcgtatgggtaaagcgcttatttatcggaagaaatccgataaataagaagcatcaaag

SEQ ID NO: 552 - DNA, 107 bp, Artificial Sequence
  scaffold variant
ctggcgcttttatctcattactttgagagccatcaccagcgactatgtcgtatgggtaaagcgcttatttatcgggagagaaatccgataaataagaagcatcaaag

SEQ ID NO: 553 - DNA, 108 bp, Artificial Sequence
  scaffold variant
tactggcgcttttattctcattactttgagagccatcaccagcgactatgtcgtatgggtaaagcgcttatttatcaagagaaatccgataaataagaagcatcaaag

SEQ ID NO: 554 - DNA, 106 bp, Artificial Sequence
  scaffold variant
tggcgcttttatctcattactttgagagccatcaccagcgactatgtcgtatgggtaaagcgcttatttatgcggagagaaatccgataaataagaagcatcaaag

SEQ ID NO: 555 - DNA, 105 bp, Artificial Sequence
  scaffold variant
ctggcgcttttatctcattactttgagagccatcaccagcgactatgtcgtatgggtaaagcgcttatttatcggagagaaaccgataaataagaagcatcaaag

SEQ ID NO: 556 - DNA, 108 bp, Artificial Sequence
  scaffold variant
cctggcgcttttatctcattactttgagagccatcaccagcgactatgtcgtatgggtaaagcgcttatttatcggagagaaatcacgataaataagaagcatcaaag

SEQ ID NO: 557 - DNA, 105 bp, Artificial Sequence
  scaffold variant
tctggcgcttttatctcattactttgagagccatcaccagcgactatgtcgtatgggtaaagcgcttatttatcggagaaatccgataaataagaagcatcaaag

SEQ ID NO: 558 - DNA, 108 bp, Artificial Sequence
  scaffold variant
tacggcgcttttatctcattactttgagagccatcaccagcgactatgtcgtatgggtaaagcgcttatttatcggagagaaatccgaataaataagaagcatcaaag

SEQ ID NO: 559 - DNA, 108 bp, Artificial Sequence
  scaffold variant
cctggcgcttttatctcattactttgagagccatcaccagcgactatgtcgtatgggtaaagcgcttatttatcggagagaaatccgataaataagagagcatcaaag

SEQ ID NO: 560 - DNA, 107 bp, Artificial Sequence
  scaffold variant
ctggcgcttttatctcattactttgagagccatcaccagcgactatgtcgtatgggtaaagcgcttatttagtcggagagaaatccgataaataagaagcatcaaag

SEQ ID NO: 561 - DNA, 108 bp, Artificial Sequence
  scaffold variant
tctggcgcttttatctcattactttgagagccatcaccagcgactatgtcgtatgggtaaagcgcttatttatacggagagaaatccgataaataagaagcatcaaag

SEQ ID NO: 562 - DNA, 107 bp, Artificial Sequence
  scaffold variant
ctggcgcttttatctcattactttgagagccatcaccagcgactatgtcgtatgggtaaagcgcttatttaatcggagagaaatccgataaataagaagcatcaaag

SEQ ID NO: 563 - DNA, 109 bp, Artificial Sequence
  scaffold variant
tactggcgcttttatctcattactttgagagccatcaccagcgactatgtcgtatgggtaaagcgcttatttatcggagagaaatcgcgataaataagaagcatcaaag

SEQ ID NO: 564 - DNA, 108 bp, Artificial Sequence
  scaffold variant
tacggcgcttttatctcattactttgagagccatcaccagcgactatgtcgtatgggtaaagcgcttatttatcggcagagaaatccgataaataagaagcatcaaag

SEQ ID NO: 565 - DNA, 108 bp, Artificial Sequence
  scaffold variant
tactggcgcttttattctcattactttgagagccatcaccagcgactatgtcgtatgggtaaagcgcttattttcggagagaaatccgataaataagaagcatcaaag

SEQ ID NO: 566 - DNA, 108 bp, Artificial Sequence
  scaffold variant
tactggcgcttttattctcattactttgagagccatcaccagcgactatgtcgtatgggtaaagcgcttatttatctagagaaatccgataaataagaagcatcaaag

SEQ ID NO: 567 - DNA, 106 bp, Artificial Sequence
  scaffold variant
cctggcgcttttatctcattactttgagagccatcaccagcgactatgtcgtatgggtaaagcgcttatttatcggagagtatccgataaataagaagcatcaaag

SEQ ID NO: 568 - DNA, 107 bp, Artificial Sequence; identical to SEQ ID NO: 484
  scaffold variant

SEQ ID NO: 569 - DNA, 105 bp, Artificial Sequence
  scaffold variant
ctggcgcttttatctcattactttgagagccatcaccagcgactatgtcgtatgggtaaagcgcttatttatcggagagaaatccataaataagaagcatcaaag

SEQ ID NO: 570 - DNA, 106 bp, Artificial Sequence
  scaffold variant
tacggcgcttttatctcattactttgagagccatcaccagcgactatgtcgtatgggtaaagcgcttatttatcgagagaaatccgataaataagaagcatcaaag

SEQ ID NO: 571 - DNA, 108 bp, Artificial Sequence
  scaffold variant
tctggcgcttttatctcattactttgagagccatcaccagcgactatgtcgtatgggtaaagcgcttatttatcggagagaaatccgaataaataagaagcatcaaag

SEQ ID NO: 572 - DNA, 108 bp, Artificial Sequence
  scaffold variant
tctggcgcttttatctcattactttgagagccatcaccagcgactatgtcgtatgggtaaagcgcttatttatcggagagaaatccgtataaataagaagcatcaaag

SEQ ID NO: 573 - DNA, 110 bp, Artificial Sequence
  scaffold variant
tactggcgcttttatcttcattactttgagagccatcaccagcgactatgtcgtatgggtaaagcgcttatttatcggagagaaatcccgataaataagaagcatcaaag

SEQ ID NO: 574 - DNA, 108 bp, Artificial Sequence
  scaffold variant
cctggcgcttttatctcattactttgagagccatcaccagcgactatgtcgtatgggtaaagcgcttatttatcgcgagagaaatccgataaataagaagcatcaaag

SEQ ID NO: 575 - DNA, 106 bp, Artificial Sequence
  scaffold variant
cctggcgcttttatctcattactttgagagccatcaccagcgactatgtcgtatgggtaaagcgcttatttatcgcgagaaatccgataaataagaagcatcaaag

SEQ ID NO: 576 - DNA, 107 bp, Artificial Sequence
  scaffold variant
cctggcgcttttatctcattactttgagagccatcaccagcgactatgtcgtatgggtaaagcgcttatttatcggtgagaaatccgataaataagaagcatcaaag

SEQ ID NO: 577 - DNA, 106 bp, Artificial Sequence
  scaffold variant
tacggcgcttttatctcattactttgagagccatcaccagcgactatgtcgtatgggtaaagcgcttatttatccagagaaatccgataaataagaagcatcaaag

SEQ ID NO: 578 - DNA, 107 bp, Artificial Sequence
  scaffold variant
ctggcgcttttatctcattactttgagagccatcaccagcgactatgtcgtatgggtaaagcgcttatttatcgagagagaaatccgataaataagaagcatcaaag

SEQ ID NO: 579 - DNA, 105 bp, Artificial Sequence; identical to SEQ ID NO: 424
  scaffold variant

SEQ ID NO: 580 - DNA, 108 bp, Artificial Sequence
  scaffold variant
cctggcgcttttatctcattactttgagagccatcaccagcgactatgtcgtatgggtaaagcgcttatttatacggagagaaatccgataaataagaagcatcaaag

SEQ ID NO: 581 - DNA, 106 bp, Artificial Sequence
  scaffold variant
actggcgcttttatctcattactttgagagccatcaccagcgactatgtcgtatgggtaaagcgcttatttatcggagagaaatccataaataagaagcatcaaag

SEQ ID NO: 582 - DNA, 107 bp, Artificial Sequence
  scaffold variant
cctggcgcttttatctcattactttgagagccatcaccagcgactatgtcgtatgggtaaagcgcttatttgtcggagagaaatccgataaataagaagcatcaaag

SEQ ID NO: 583 - DNA, 110 bp, Artificial Sequence
  scaffold variant
tactggcgcttttatctcattactttcgagagccatcaccagcgactatgtcgtatgggtaaagcgcttatttatcggcagagaaatccgataaataagaagcatcaaag

SEQ ID NO: 584 - DNA, 105 bp, Artificial Sequence
  scaffold variant
cctggcgcttttatctcattactttgagagccatcaccagcgactatgtcgtatgggtaaagcgtatttatcggagagaaatccgataaataagaagcatcaaag

SEQ ID NO: 585 - DNA, 104 bp, Artificial Sequence
  scaffold variant
tggcgcttttatctcattactttgagagccatcaccagcgactatgtcgtatgggtaaagcgcttatttatcgggagaaatccgataaataagaagcatcaaag

SEQ ID NO: 586 - DNA, 108 bp, Artificial Sequence
  scaffold variant
cctggcgcttttattctcattactttgagagccatcaccagcgactatgtcgtatgggtaaagcgcttatttatcggagagaaatccgataaataagaagcatcaaag

SEQ ID NO: 587 - DNA, 106 bp, Artificial Sequence
  scaffold variant
cctggcgcttttatctcattactttgagagccatcaccagcgactatgtcgtatgggtaaagcgcttatttatcggagagattccgataaataagaagcatcaaag

SEQ ID NO: 588 - DNA, 107 bp, Artificial Sequence
  scaffold variant
ctggcgcttttatctcattactttgagagccatcaccagcgactatgtcgtatgggtaaagcgcttatttatcggagagaaataccgataaataagaagcatcaaag

SEQ ID NO: 589 - DNA, 106 bp, Artificial Sequence
  scaffold variant
tacggcgcttttatctcattactttgagagccatcaccagcgactatgtcgtatgggtaaagcgcttatttatcgtgagaaatccgataaataagaagcatcaaag

SEQ ID NO: 590 - DNA, 105 bp, Artificial Sequence
  scaffold variant
ctggcgcttttatctcattactttgagagccatcaccagcgactatgtcgtatgggtaaagcgcttatttatcggagagaaatcgataaataagaagcatcaaag

SEQ ID NO: 591 - DNA, 106 bp, Artificial Sequence
  scaffold variant
cctggcgcttttatctcattactttgagagccatcaccagcgactatgtcgtatgggtaaagcgcttatttatcggagagaaatcgataaataagaagcatcaaag

SEQ ID NO: 592 - DNA, 106 bp, Artificial Sequence
  scaffold variant
actggcgcttttatctcattactttgagagccatcaccagcgactatgtcgtatgggtaaagcgcttatttatcggagagaaatccgtaaataagaagcatcaaag

SEQ ID NO: 593 - DNA, 108 bp, Artificial Sequence
  scaffold variant
tactggcgcttttatctcattactttcgagagccatcaccagcgactatgtcgtatgggtaaagcgcttatttatcggagagaatccgataaataagaagcatcaaag

SEQ ID NO: 594 - DNA, 110 bp, Artificial Sequence
  scaffold variant
tactggcgcttttattctcattactttgagagccatcaccagcgactatgtcgtatgggtaaagcgcttatttatctggagagaaatccgataaataagaagcatcaaag

SEQ ID NO: 595 - DNA, 108 bp, Artificial Sequence
  scaffold variant
tactggcgcttttatctcattactttagagagccatcaccagcgactatgtcgtatgggtaaagcgcttatttatcgagagaaatccgataaataagaagcatcaaag

SEQ ID NO: 596 - DNA, 110 bp, Artificial Sequence
  scaffold variant
tactggcgcttttattctcattactttgagagccatcaccagcgactatgtcgtatgggtaaagcgcttatttatcgggagagaaatccgataaataagaagcatcaaag

SEQ ID NO: 597 - DNA, 107 bp, Artificial Sequence
  scaffold variant
ctggcgcttttatctcattactttgagagccatcaccagcgactatgtcgtatgggtaaagcgcttatttatcggagagaaatcctgataaataagaagcatcaaag

SEQ ID NO: 598 - DNA, 108 bp, Artificial Sequence
  scaffold variant
tctggcgcttttatctcattactttgagagccatcaccagcgactatgtcgtatgggtaaagcgcttatttatcaggagagaaatccgataaataagaagcatcaaag

SEQ ID NO: 599 - DNA, 108 bp, Artificial Sequence
  scaffold variant
cctggcgcttttatctcattactttgcagagccatcaccagcgactatgtcgtatgggtaaagcgcttatttatcggagagaaatccgataaataagaagcatcaaag

SEQ ID NO: 600 - DNA, 105 bp, Artificial Sequence
  scaffold variant
tacggcgcttttatctcattactttgagagccatcaccagcgactatgtcgtatgggtaaagcgcttatttatcggagaaatccgataaataagaagcatcaaag

SEQ ID NO: 601 - DNA, 106 bp, Artificial Sequence
  scaffold variant
actggcgcttttatctcattactttgagagccatcaccagcgactatgtcgtatgggtaaagcgcttatttatcgcgagaaatccgataaataagaagcatcaaag

SEQ ID NO: 602 - DNA, 110 bp, Artificial Sequence
  scaffold variant
tactggcgcttttatcctcattactttgagagccatcaccagcgactatgtcgtatgggtaaagcgcttatttatcggagagaaatcacgataaataagaagcatcaaag

SEQ ID NO: 603 - DNA, 106 bp, Artificial Sequence
  scaffold variant
tacggcgcttttatctcattactttgagagccatcaccagcgactatgtcgtatgggtaaagcgcttatttgcggagagaaatccgataaataagaagcatcaaag

SEQ ID NO: 604 - DNA, 106 bp, Artificial Sequence
  scaffold variant
cctggcgcttttatctcattactttgagagccatcaccagcgactatgtcgtatgggtaaagcgcttatttatcggagacaatccgataaataagaagcatcaaag

SEQ ID NO: 605 - DNA, 106 bp, Artificial Sequence
  scaffold variant
actggcgcttttatctcattactttgagagccatcaccagcgactatgtcgtatgggtaaagcgcttatttatcggtagaaatccgataaataagaagcatcaaag

SEQ ID NO: 606 - DNA, 108 bp, Artificial Sequence
  scaffold variant
tctggcgcttttatctcattactttgagagccatcaccagcgactatgtcgtatgggtaaagcgcttatttatcgtgagagaaatccgataaataagaagcatcaaag

SEQ ID NO: 607 - DNA, 108 bp, Artificial Sequence
  scaffold variant
tacggcgcttttatctcattactttgagagccatcaccagcgactatgtcgtatgggtaaagcgcttatttatcgagagagaaatccgataaataagaagcatcaaag

SEQ ID NO: 608 - DNA, 107 bp, Artificial Sequence
  scaffold variant
ctggcgcttttatctcattactttgagagccatcaccagcgactatgtcgtatgggtaaagcgcttatttatcggagagaaatctcgataaataagaagcatcaaag

SEQ ID NO: 609 - DNA, 108 bp, Artificial Sequence
  scaffold variant
actggcgcttttatcttcattactttgagagccatcaccagcgactatgtcgtatgggtaaagcgcttatttatcggagagaaatccgataaataagaagcatcaaag

SEQ ID NO: 610 - DNA, 108 bp, Artificial Sequence
  scaffold variant
cctggcgcttttatctcattactttgagagccatcaccagcgactatgtcgtatgggtaaagcgcttatttatcggagagacaatccgataaataagaagcatcaaag

SEQ ID NO: 611 - DNA, 110 bp, Artificial Sequence
  scaffold variant
tactggcgcttttatcctcattactttgagagccatcaccagcgactatgtcgtatgggtaaagcgcttatttattcggagagaaatccgataaataagaagcatcaaag

SEQ ID NO: 612 - DNA, 106 bp, Artificial Sequence
  scaffold variant
cctggcgcttttatctcattactttgagagccatcaccagcgactatgtcgtatgggtaaagcgcttatttatcggacgaaatccgataaataagaagcatcaaag

SEQ ID NO: 613 - DNA, 106 bp, Artificial Sequence
  scaffold variant
gctggcgcttttatctcattactttgagagccatcaccagcgactatgtcgtatgggtaaagcgcttatttatctagagaaatccgataaataagaagcatcaaag

SEQ ID NO: 614 - DNA, 108 bp, Artificial Sequence
  scaffold variant
gctggcgcttttatctcattactttagagagccatcaccagcgactatgtcgtatgggtaaagcgcttatttatcggagagaaatccgataaataagaagcatcaaag

SEQ ID NO: 615 - DNA, 106 bp, Artificial Sequence
  scaffold variant
cctggcgcttttatctcattactttgagagccatcaccagcgactatgtcgtatgggtaaagcgcttatttgcggagagaaatccgataaataagaagcatcaaag

SEQ ID NO: 616 - DNA, 109 bp, Artificial Sequence
  scaffold variant
tactggcgcttttatctcattactttgagagccatcaccagcgactatgtcgtagtgggtaaagcgcttatttatcggagagaaatccgataaataagaagcatcaaag

SEQ ID NO: 617 - DNA, 108 bp, Artificial Sequence
  scaffold variant
tacggcgcttttatctcattactttgagagccatcaccagcgactatgtcgtatgggtaaagcgcttatttatcgggagagaaatccgataaataagaagcatcaaag

SEQ ID NO: 618 - DNA, 108 bp, Artificial Sequence
  scaffold variant
gctggcgcttttatctcattactttgagagccatcaccagcgactatgtcgtatgggtaaagcgcttatttatgcggagagaaatccgataaataagaagcatcaaag

SEQ ID NO: 619 - DNA, 108 bp, Artificial Sequence
  scaffold variant
actggcgcttttatctcattactttcgagagccatcaccagcgactatgtcgtatgggtaaagcgcttatttatcggagagaaatccgataaataagaagcatcaaag

SEQ ID NO: 620 - DNA, 108 bp, Artificial Sequence
  scaffold variant
tactggcgcttttatctcattactttgagagccatcaccagcgactatgtcgtattgggtaaagcgcttatttatcgagagaaatccgataaataagaagcatcaaag

SEQ ID NO: 621 - DNA, 108 bp, Artificial Sequence
  scaffold variant
actggcgcttttatctcattactttgagagccatcaccagcgactatgtcgtatgggtaaagcgcttatttatcgggagagaaatccgataaataagaagcatcaaag

SEQ ID NO: 622 - DNA, 108 bp, Artificial Sequence
  scaffold variant
tactggcgcttttatctcattactttagagagccatcaccagcgactatgtcgtatgggtaaagcgcttatttatcaagagaaatccgataaataagaagcatcaaag

SEQ ID NO: 623 - DNA, 107 bp, Artificial Sequence
  scaffold variant
ctggcgcttttatctcattactttgagagccatcaccagcgactatgtcgtatgggtaaagcgcttatttatacggagagaaatccgataaataagaagcatcaaag

SEQ ID NO: 624 - DNA, 108 bp, Artificial Sequence
  scaffold variant
tactggcgcttttatctcattactttcgagagccatcaccagcgactatgtcgtatgggtaaagcgcttatttacggagagaaatccgataaataagaagcatcaaag

SEQ ID NO: 625 - DNA, 105 bp, Artificial Sequence
  scaffold variant
actggcgcttttatctcattactttgagagccatcaccagcgactatgtcgtatgggtaaagcgcttatttatcggagaaatccgataaataagaagcatcaaag

SEQ ID NO: 626 - DNA, 108 bp, Artificial Sequence
  scaffold variant
tactggcgcttttatcttcattactttgagagccatcaccagcgactatgtcgtatgggtaaagcgcttatttatccagagaaatccgataaataagaagcatcaaag

SEQ ID NO: 627 - DNA, 106 bp, Artificial Sequence
  scaffold variant
tacggcgcttttatctcattactttgagagccatcaccagcgactatgtcgtatgggtaaagcgcttatttatcaagagaaatccgataaataagaagcatcaaag

SEQ ID NO: 628 - DNA, 108 bp, Artificial Sequence
  scaffold variant
tacggcgcttttatctcattactttgagagccatcaccagcgactatgtcgtatgggtaaagcgcttatttatcggagagaaatgccgataaataagaagcatcaaag

SEQ ID NO: 629 - DNA, 106 bp, Artificial Sequence
  scaffold variant
cctggcgcttttatctcattactttgagagccatcaccagcgactatgtcgtatgggtaaagcgcttatttatcggagagaaatccctaaataagaagcatcaaag

SEQ ID NO: 630 - DNA, 107 bp, Artificial Sequence; identical to SEQ ID NO: 484
  scaffold variant

SEQ ID NO: 631 - DNA, 106 bp, Artificial Sequence
  scaffold variant
tactggcgcttttatctcattactttagagccatcaccagcgactatgtcgtatgggtaaagcgcttatttatccagagaaatccgataaataagaagcatcaaag

SEQ ID NO: 632 - DNA, 107 bp, Artificial Sequence
  scaffold variant
cctggcgcttttatctcattactttgagagccatcaccagcgactatgtcgtatgggtaaagcgcttatttatcggggagaaatccgataaataagaagcatcaaag

SEQ ID NO: 633 - DNA, 110 bp, Artificial Sequence
  scaffold variant
tactggcgcttttatcttcattactttgagagccatcaccagcgactatgtcgtatgggtaaagcgcttatttatcggtagagaaatccgataaataagaagcatcaaag

SEQ ID NO: 634 - DNA, 108 bp, Artificial Sequence
  scaffold variant
tactggcgcttttattctcattactttgagagccatcaccagcgactatgtcgtatgggtaaagcgcttatttacggagagaaatccgataaataagaagcatcaaag

SEQ ID NO: 635 - DNA, 110 bp, Artificial Sequence
  scaffold variant
tactggcgcttttatcttcattactttgagagccatcaccagcgactatgtcgtatgggtaaagcgcttatttatcggagagaaatcgcgataaataagaagcatcaaag

SEQ ID NO: 636 - DNA, 106 bp, Artificial Sequence
  scaffold variant
tacggcgcttttatctcattactttgagagccatcaccagcgactatgtcgtatgggtaaagcgcttatttatcggagagaaatccataaataagaagcatcaaag

SEQ ID NO: 637 - DNA, 108 bp, Artificial Sequence
  scaffold variant
tactggcgcttttatctcattactttcgagagccatcaccagcgactatgtcgtatgggtaaagcgcttatttatcgcgagaaatccgataaataagaagcatcaaag

SEQ ID NO: 638 - DNA, 107 bp, Artificial Sequence
  scaffold variant
tacggcgcttttatctcattactttgagagccatcaccagcgactatgtcgtatgggtaaagcgcttatttgtcggagagaaatccgataaataagaagcatcaaag

SEQ ID NO: 639 - DNA, 105 bp, Artificial Sequence
  scaffold variant
atggcgcttttatctcattactttgagagccatcaccagcgactatgtcgtatgggtaaagcgcttatttatctagagaaatccgataaataagaagcatcaaag

SEQ ID NO: 640 - DNA, 108 bp, Artificial Sequence
  scaffold variant
actggcgcttttatctcattactttgagagccatcaccagcgactatgtcgtatgggtaaagcgcttatttatcggagagaaatccgtataaataagaagcatcaaag

SEQ ID NO: 641 - DNA, 108 bp, Artificial Sequence
  scaffold variant
actggcgcttttatctcattactttgagagccatcaccagcgactatgtcgtatgggtaaagcgcttatttatcgagagagaaatccgataaataagaagcatcaaag

SEQ ID NO: 642 - DNA, 108 bp, Artificial Sequence
  scaffold variant
tacggcgcttttatctcattactttgagagccatcaccagcgactatgtcgtatgggtaaagcgcttatttatgcggagagaaatccgataaataagaagcatcaaag

SEQ ID NO: 643 - DNA, 108 bp, Artificial Sequence
  scaffold variant
tactggcgcttttatcctcattactttgagagccatcaccagcgactatgtcgtatgggtaaagcgcttatttatcgagagaaatccgataaataagaagcatcaaag

SEQ ID NO: 644 - DNA, 108 bp, Artificial Sequence
  scaffold variant
cctggcgcttttatctcattactttgagagccatcaccagcgactatgtcgtatgggtaaagcgcttatttatcggagagaaatgccgataaataagaagcatcaaag

SEQ ID NO: 645 - DNA, 108 bp, Artificial Sequence
  scaffold variant
actggcgcttttatctcattactttgagagccatcaccagcgactatgtcgtatgggtaaagcgcttatttagtcggagagaaatccgataaataagaagcatcaaag

SEQ ID NO: 646 - DNA, 110 bp, Artificial Sequence
  scaffold variant
tactggcgcttttatcctcattactttgagagccatcaccagcgactatgtcgtatgggtaaagcgcttatttatcggagagaaatcgcgataaataagaagcatcaaag

SEQ ID NO: 647 - DNA, 108 bp, Artificial Sequence
  scaffold variant
tctggcgcttttatctcattactttgagagccatcaccagcgactatgtcgtatgggtaaagcgcttatttatcggagagaaataccgataaataagaagcatcaaag

SEQ ID NO: 648 - DNA, 107 bp, Artificial Sequence
  scaffold variant
tctggcgcttttatctcattactttgagagccatcaccagcgactatgtcgtatgggtaaagcgcttatttctcggagagaaatccgataaataagaagcatcaaag

SEQ ID NO: 649 - DNA, 106 bp, Artificial Sequence
  scaffold variant
actggcgcttttatctcattactttgagagccatcaccagcgactatgtcgtatgggtaaagcgcttatttatcggaagaaatccgataaataagaagcatcaaag

SEQ ID NO: 650 - DNA, 108 bp, Artificial Sequence
  scaffold variant
cctggcgcttttatctcattactttgagagccatcaccagcgactatgtcgtatgggtaaagcgcttatttatcggagagaaatccgataaataagtaagcatcaaag

SEQ ID NO: 651 - DNA, 108 bp, Artificial Sequence
  scaffold variant
tactggcgcttttatctctattactttgagagccatcaccagcgactatgtcgtatgggtaaagcgcttatttatcggagagaaatccataaataagaagcatcaaag

SEQ ID NO: 652 - DNA, 106 bp, Artificial Sequence
  scaffold variant
tacggcgcttttatctcattactttgagagccatcaccagcgactatgtcgtatgggtaaagcgcttatttatcggaagaaatccgataaataagaagcatcaaag

SEQ ID NO: 653 - DNA, 105 bp, Artificial Sequence
  scaffold variant
ctggcgcttttatctcattactttgagagccatcaccagcgactatgtcgtatgggtaaagcgcttatttatcggagataatccgataaataagaagcatcaaag

SEQ ID NO: 654 - DNA, 104 bp, Artificial Sequence
  scaffold variant
ctggcgcttttatctcattactttgagagccatcaccagcgactatgtcgtatgggtaaagcgcttatttatcggagaaatccgataaataagaagcatcaaag

SEQ ID NO: 655 - DNA, 108 bp, Artificial Sequence
  scaffold variant
tctggcgcttttatctcattactttgagagccatcaccagcgactatgtcgtatgggtaaagcgcttatttatccggagagaaatccgataaataagaagcatcaaag

SEQ ID NO: 656 - DNA, 106 bp, Artificial Sequence
  scaffold variant
cctggcgcttttatctcattactttgagagccatcaccagcgactatgtcgtatgggtaaagcgcttatttatcggagagaaatccggaaataagaagcatcaaag

SEQ ID NO: 657 - DNA, 106 bp, Artificial Sequence
  scaffold variant
tctggcgcttttatctcattactttgagagccatcaccagcgactatgtcgtatgggtaaagcgcttatttatcggagacaatccgataaataagaagcatcaaag

SEQ ID NO: 658 - DNA, 108 bp, Artificial Sequence
  scaffold variant
tactggcgcttttatcctcattactttgagagccatcaccagcgactatgtcgtatgggtaaagcgcttatttatcgggagaaatccgataaataagaagcatcaaag

SEQ ID NO: 659 - DNA, 105 bp, Artificial Sequence; identical to SEQ ID NO: 424
  scaffold variant

SEQ ID NO: 660 - DNA, 110 bp, Artificial Sequence
  scaffold variant
tactggcgcttttatctcattactttgagagccatcaccagcgactatgtcgtatgggtaaagcgcttatttatgcggagagaaatcgcgataaataagaagcatcaaag

SEQ ID NO: 661 - DNA, 108 bp, Artificial Sequence
  scaffold variant
ctactggcgcttttatctcattactttgagagccatcaccagcgactatgtcgtatgggtaaagcgcttatttatcgagagaaatccgataaataagaagcatcaaag

SEQ ID NO: 662 - DNA, 110 bp, Artificial Sequence
  scaffold variant
tactggcgcttttatcatcattactttgagagccatcaccagcgactatgtcgtatgggtaaagcgcttatttatcgggagagaaatccgataaataagaagcatcaaag

SEQ ID NO: 663 - DNA, 106 bp, Artificial Sequence
  scaffold variant
cctggcgcttttatctcattactttgagagccatcaccagcgactatgtcgtatgggtaaagcggtatttatcggagagaaatccgataaataagaagcatcaaag

SEQ ID NO: 664 - DNA, 108 bp, Artificial Sequence
  scaffold variant
tacggcgcttttatctcattactttgagagccatcaccagcgactatgtcgtatgggtaaagcgcttatttactcggagagaaatccgataaataagaagcatcaaag

SEQ ID NO: 665 - DNA, 108 bp, Artificial Sequence
  scaffold variant
tactggcgcttttatactcattactttgagagccatcaccagcgactatgtcgtatgggtaaagcgcttatttatcgagagaaatccgataaataagaagcatcaaag

SEQ ID NO: 666 - DNA, 106 bp, Artificial Sequence
  scaffold variant
cctggcgcttttatctcattactttagagccatcaccagcgactatgtcgtatgggtaaagcgcttatttatcggagagaaatccgataaataagaagcatcaaag

SEQ ID NO: 667 - DNA, 108 bp, Artificial Sequence
  scaffold variant
actggcgcttttatctcattactttgagagccatcaccagcgactatgtcgtatgggtaaagcgcttatttatcaggagagaaatccgataaataagaagcatcaaag

SEQ ID NO: 668 - DNA, 108 bp, Artificial Sequence
  scaffold variant
tactggcgcttttatctcattactttcgagagccatcaccagcgactatgtcgtatgggtaaagcgcttatttatcggaggaaatccgataaataagaagcatcaaag

SEQ ID NO: 669 - DNA, 110 bp, Artificial Sequence
  scaffold variant
tactggcgcttttatctctattactttgagagccatcaccagcgactatgtcgtatgggtaaagcgcttatttatccggagagaaatccgataaataagaagcatcaaag

SEQ ID NO: 670 - DNA, 106 bp, Artificial Sequence
  scaffold variant
cctggcgcttttatctcattactttgagagccatcaccagcgactatgtcgtatgggtaaagcgcttattatcggagagaaatccgataaataagaagcatcaaag

SEQ ID NO: 671 - DNA, 110 bp, Artificial Sequence
  scaffold variant
ttactggcgcttttatctcattactttgagagccatcaccagcgactatgtcgtatgggtaaagcgcttatttatgcggagagaaatccgataaataagaagcatcaaag

SEQ ID NO: 672 - DNA, 108 bp, Artificial Sequence
  scaffold variant
tactggcgcttttatctcattactttagagccatcaccagcgactatgtcgtatgggtaaagcgcttatttatcggagagaaatcgcgataaataagaagcatcaaag

SEQ ID NO: 673 - DNA, 108 bp, Artificial Sequence
  scaffold variant
tacggcgcttttatctcattactttgagagccatcaccagcgactatgtcgtatgggtaaagcgcttatttatcggagagaaatccgcataaataagaagcatcaaag

SEQ ID NO: 674 - DNA, 110 bp, Artificial Sequence
  scaffold variant
tactggcgcttttatcctcattactttgagagccatcaccagcgactatgtcgtatgggtaaagcgcttatttaatcggagagaaatccgataaataagaagcatcaaag

SEQ ID NO: 675 - DNA, 108 bp, Artificial Sequence
  scaffold variant
cctggcgcttttatctctattactttgagagccatcaccagcgactatgtcgtatgggtaaagcgcttatttatcggagagaaatccgataaataagaagcatcaaag

SEQ ID NO: 676 - DNA, 106 bp, Artificial Sequence
  scaffold variant
actggcgcttttatctcattactttgagagccatcaccagcgactatgtcgtatgggtaaagcgcttatttatcgggagaaatccgataaataagaagcatcaaag

SEQ ID NO: 677 - DNA, 106 bp, Artificial Sequence
  scaffold variant
actggcgcttttatctcattactttgagagccatcaccagcgactatgtcgtatgggtaaagcgcttatttatcggagagtatccgataaataagaagcatcaaag

SEQ ID NO: 678 - DNA, 106 bp, Artificial Sequence
  scaffold variant
cctggcgcttttatctcattactttgagagccatcaccagcgactatgtcgtatgggtaaagcgcttatttatcgggagaaatccgataaataagaagcatcaaag

SEQ ID NO: 679 - DNA, 107 bp, Artificial Sequence; identical to SEQ ID NO: 484
  scaffold variant

SEQ ID NO: 680 - DNA, 108 bp, Artificial Sequence
  scaffold variant
tctggcgcttttatctcattactttgagagccatcaccagcgactatgtcgtatgggtaaagcgcttatttactcggagagaaatccgataaataagaagcatcaaag

SEQ ID NO: 681 - DNA, 108 bp, Artificial Sequence
  scaffold variant
cctggcgcttttatcctcattactttgagagccatcaccagcgactatgtcgtatgggtaaagcgcttatttatcggagagaaatccgataaataagaagcatcaaag

SEQ ID NO: 682 - DNA, 107 bp, Artificial Sequence
  scaffold variant
atggcgcttttatctcattactttgagagccatcaccagcgactatgtcgtatgggtaaagcgcttatttatcggagagaaatcgcgataaataagaagcatcaaag

SEQ ID NO: 683 - DNA, 105 bp, Artificial Sequence
  scaffold variant
ctggcgcttttatctcattactttgagagccatcaccagcgactatgtcgtatgggtaaagcgcttatttatcggtagaaatccgataaataagaagcatcaaag

SEQ ID NO: 684 - DNA, 110 bp, Artificial Sequence
  scaffold variant
tactggcgcttttatctgcattactttgagagccatcaccagcgactatgtcgtatgggtaaagcgcttatttatgcggagagaaatccgataaataagaagcatcaaag

SEQ ID NO: 685 - DNA, 106 bp, Artificial Sequence
  scaffold variant
tacggcgcttttatctcattactttgagagccatcaccagcgactatgtcgtatgggtaaagcgcttatttatcggagagaaatccgtaaataagaagcatcaaag

SEQ ID NO: 686 - DNA, 108 bp, Artificial Sequence
  scaffold variant
tactggcgcttttatctcattactttgcagagccatcaccagcgactatgtcgtatgggtaaagcgcttatttatcgggagaaatccgataaataagaagcatcaaag

SEQ ID NO: 687 - DNA, 107 bp, Artificial Sequence
  scaffold variant
cctggcgcttttatctcattactttgagagccatcaccagcgactatgtcgtatgggtaaagcgcttatttctcggagagaaatccgataaataagaagcatcaaag

SEQ ID NO: 688 - DNA, 108 bp, Artificial Sequence
  scaffold variant
tctggcgcttttatctcattactttgagagccatcaccagcgactatgtcgtatgggtaaagcgcttatttagtcggagagaaatccgataaataagaagcatcaaag

SEQ ID NO: 689 - DNA, 108 bp, Artificial Sequence
  scaffold variant
tactggcgcttttattctcattactttgagagccatcaccagcgactatgtcgtatgggtaaagcgcttatttatcggagagaaagcgataaataagaagcatcaaag

SEQ ID NO: 690 - DNA, 108 bp, Artificial Sequence
  scaffold variant
tctggcgcttttatctcattactttgagagccatcaccagcgactatgtcgtatgggtaaagcgcttatttatcggagagataatccgataaataagaagcatcaaag

SEQ ID NO: 691 - DNA, 106 bp, Artificial Sequence
  scaffold variant
tctggcgcttttatctcattactttgagagccatcaccagcgactatgtcgtatgggtaaagcgcttatttatcggaagaaatccgataaataagaagcatcaaag

SEQ ID NO: 692 - DNA, 106 bp, Artificial Sequence
  scaffold variant
tacggcgcttttatctcattactttgagagccatcaccagcgactatgtcgtatgggtaaagcgcttatttatcggagataatccgataaataagaagcatcaaag

SEQ ID NO: 693 - DNA, 107 bp, Artificial Sequence
  scaffold variant
tctggcgcttttatctcattactttgagagccatcaccagcgactatgtcgtatgggtaaagcgcttatttatcggtgagaaatccgataaataagaagcatcaaag

SEQ ID NO: 694 - DNA, 110 bp, Artificial Sequence
  scaffold variant
tactggcgcttttatcctcattactttgagagccatcaccagcgactatgtcgtatgggtaaagcgcttatttatacggagagaaatccgataaataagaagcatcaaag

SEQ ID NO: 695 - DNA, 108 bp, Artificial Sequence
  scaffold variant
tctggcgcttttatctcattactttgagagccatcaccagcgactatgtcgtatgggtaaagcgcttattctatcggagagaaatccgataaataagaagcatcaaag

SEQ ID NO: 696 - DNA, 105 bp, Artificial Sequence; identical to SEQ ID NO: 473
  scaffold variant

SEQ ID NO: 697 - DNA, 106 bp, Artificial Sequence
  scaffold variant
tacggcgcttttatctcattactttgagagccatcaccagcgactatgtcgtatgggtaaagcgcttatttatcggcagaaatccgataaataagaagcatcaaag

SEQ ID NO: 698 - DNA, 110 bp, Artificial Sequence
  scaffold variant
tactggcgcttttatctcgattactttgagagccatcaccagcgactatgtcgtatgggtaaagcgcttatttattcggagagaaatccgataaataagaagcatcaaag

SEQ ID NO: 699 - DNA, 110 bp, Artificial Sequence
  scaffold variant
tactggcgcttttatcttcattactttgagagccatcaccagcgactatgtcgtatgggtaaagcgcttatttatcggagagaaatgccgataaataagaagcatcaaag

SEQ ID NO: 700 - DNA, 106 bp, Artificial Sequence
  scaffold variant
actggcgcttttatctcattactttgagagccatcaccagcgactatgtcgtatgggtaaagcgttatttatcggagagaaatccgataaataagaagcatcaaag

SEQ ID NO: 701 - DNA, 110 bp, Artificial Sequence
  scaffold variant
tactggcgcttttatctcattactttgagagccatcaccagcgactatgtcgtagtgggtaaagcgcttatttatgcggagagaaatccgataaataagaagcatcaaag

SEQ ID NO: 702 - DNA, 107 bp, Artificial Sequence
  scaffold variant
ctggcgcttttatctcattactttgagagccatcaccagcgactatgtcgtatgggtaaagcgcttatttatcggagagaaatcacgataaataagaagcatcaaag

SEQ ID NO: 703 - DNA, 108 bp, Artificial Sequence
  scaffold variant
tctggcgcttttatctcattactttgagagccatcaccagcgactatgtcgtatgggtaaagcgcttatttatcggagagaaatgccgataaataagaagcatcaaag

SEQ ID NO: 704 - DNA, 105 bp, Artificial Sequence
  scaffold variant
ctggcgcttttatctcattactttgagagccatcaccagcgactatgtcgtatgggtaaagcgcttatttatcggcagaaatccgataaataagaagcatcaaag

SEQ ID NO: 705 - DNA, 108 bp, Artificial Sequence
  scaffold variant
tactggcgcttttatctcattactttagagagccatcaccagcgactatgtcgtatgggtaaagcgcttatttattgagagaaatccgataaataagaagcatcaaag

SEQ ID NO: 706 - DNA, 108 bp, Artificial Sequence
  scaffold variant
tactggcgcttttatctcgattactttgagagccatcaccagcgactatgtcgtatgggtaaagcgcttatttacggagagaaatccgataaataagaagcatcaaag

SEQ ID NO: 707 - DNA, 110 bp, Artificial Sequence
  scaffold variant
tacctggcgcttttatctcattactttgagagccatcaccagcgactatgtcgtatgggtaaagcgcttatttatgcggagagaaatccgataaataagaagcatcaaag

SEQ ID NO: 708 - DNA, 110 bp, Artificial Sequence
  scaffold variant
tactggcgcttttatctcattactttagagagccatcaccagcgactatgtcgtatgggtaaagcgcttatttatacggagagaaatccgataaataagaagcatcaaag

SEQ ID NO: 709 - DNA, 108 bp, Artificial Sequence
  scaffold variant
tactggcgcttttatctctattactttgagagccatcaccagcgactatgtcgtatgggtaaagcgcttatttatcggagagaaatcgataaataagaagcatcaaag

SEQ ID NO: 710 - DNA, 110 bp, Artificial Sequence
  scaffold variant
tactggcgcttttattctcattactttgagagccatcaccagcgactatgtcgtatgggtaaagcgcttatttatcggagagaaatcccgataaataagaagcatcaaag

SEQ ID NO: 711 - DNA, 106 bp, Artificial Sequence
  scaffold variant
cctggcgcttttatctcattactttgagagccatcaccagcgactatgtcgtatgggtaaagctttatttatcggagagaaatccgataaataagaagcatcaaag

SEQ ID NO: 712 - DNA, 108 bp, Artificial Sequence
  scaffold variant
tctggcgcttttatctcattactttgagagccatcaccagcgactatgtcgtatgggtaaagcgcttatttatcggagagaaatccgactaaataagaagcatcaaag

SEQ ID NO: 713 - DNA, 108 bp, Artificial Sequence
  scaffold variant
tactggcgcttttatcttcattactttgagagccatcaccagcgactatgtcgtatgggtaaagcgcttatttatcggagagaaatccataaataagaagcatcaaag

SEQ ID NO: 714 - DNA, 108 bp, Artificial Sequence
  scaffold variant
tacggcgcttttatctcattactttgagagccatcaccagcgactatgtcgtattgggtaaagcgcttatttatcggagagaaatccgataaataagaagcatcaaag

SEQ ID NO: 715 - DNA, 108 bp, Artificial Sequence
  scaffold variant
cctggcgcttttatctcattactttgagagccatcaccagcgactatgtcgtatgggtaaagcgcttatttatcggtagagaaatccgataaataagaagcatcaaag

SEQ ID NO: 716 - DNA, 106 bp, Artificial Sequence
  scaffold variant
cctggcgcttttatctcattactttgagagccatcaccagcgactatgtcgtatgggtaaagcgcttatttatcggatgaaatccgataaataagaagcatcaaag

SEQ ID NO: 717 - DNA, 108 bp, Artificial Sequence
  scaffold variant
actggcgcttttatctcattactttgagagccatcaccagcgactatgtcgtatgggtaaagcgcttattatatcggagagaaatccgataaataagaagcatcaaag

SEQ ID NO: 718 - DNA, 108 bp, Artificial Sequence
  scaffold variant
tctggcgcttttatctcattactttgagagccatcaccagcgactatgtcgtatgggtaaagcgcttatttatcgagagagaaatccgataaataagaagcatcaaag

SEQ ID NO: 719 - DNA, 106 bp, Artificial Sequence
  scaffold variant
tacggcgcttttatctcattactttgagagccatcaccagcgactatgtcgtatgggtaaagcgcttatttacggagagaaatccgataaataagaagcatcaaag

SEQ ID NO: 720 - DNA, 108 bp, Artificial Sequence
  scaffold variant
tctggcgcttttatctcattactttgagagccatcaccagcgactatgtcgtatgggtaaagcgcttatttatcggagagaaatcctgataaataagaagcatcaaag

SEQ ID NO: 721 - DNA, 106 bp, Artificial Sequence
  scaffold variant
cctggcgcttttatctcattactttgagagccatcaccagcgactatgtcgtatgggtaaagcgcttatttatggagagaaatccgataaataagaagcatcaaag

SEQ ID NO: 722 - DNA, 105 bp, Artificial Sequence
  scaffold variant
atggcgcttttatctcattactttgagagccatcaccagcgactatgtcgtatgggtaaagcgcttattttcggagagaaatccgataaataagaagcatcaaag

SEQ ID NO: 723 - DNA, 107 bp, Artificial Sequence
  scaffold variant
ctggcgcttttatctcattactttgagagccatcaccagcgactatgtcgtatgggtaaagcgcttatttatcggagagaaatccgtataaataagaagcatcaaag

SEQ ID NO: 724 - DNA, 108 bp, Artificial Sequence
  scaffold variant
tctggcgcttttatctcattactttgagagccatcaccagcgactatgtcgtatgggtaaagcgcttatttatcggtagagaaatccgataaataagaagcatcaaag

SEQ ID NO: 725 - DNA, 110 bp, Artificial Sequence
  scaffold variant
tactggcgcttttatctcattactttgcagagccatcaccagcgactatgtcgtatgggtaaagcgcttatttattcggagagaaatccgataaataagaagcatcaaag

SEQ ID NO: 726 - DNA, 110 bp, Artificial Sequence
  scaffold variant
tactggcgcttttattctcattactttgagagccatcaccagcgactatgtcgtatgggtaaagcgcttatttatcggagagaaatgccgataaataagaagcatcaaag

SEQ ID NO: 727 - DNA, 105 bp, Artificial Sequence
  scaffold variant
tctggcgcttttatctcattactttgagagccatcaccagcgactatgtcgtatgggtaaagcgcttatttatcggggaaatccgataaataagaagcatcaaag

SEQ ID NO: 728 - DNA, 108 bp, Artificial Sequence
  scaffold variant
tacggcgcttttatctcattactttgagagccatcaccagcgactatgtcgtatgggtaaagcgcttatttatacggagagaaatccgataaataagaagcatcaaag

SEQ ID NO: 729 - DNA, 108 bp, Artificial Sequence
  scaffold variant
tactggcgcttttattctcattactttgagagccatcaccagcgactatgtcgtatgggtaaagcgcttatttatcggagagaaatcgataaataagaagcatcaaag

SEQ ID NO: 730 - DNA, 110 bp, Artificial Sequence
  scaffold variant
tactggcgcttttattctcattactttgagagccatcaccagcgactatgtcgtatgggtaaagcgcttatttatcggagagaaatctcgataaataagaagcatcaaag

SEQ ID NO: 731 - DNA, 110 bp, Artificial Sequence
  scaffold variant
tactggcgcttttattctcattactttgagagccatcaccagcgactatgtcgtatgggtaaagcgcttatttaatcggagagaaatccgataaataagaagcatcaaag

SEQ ID NO: 732 - DNA, 108 bp, Artificial Sequence
  scaffold variant
tactggcgcttttatctcattactttgagagccatcaccagcgactatgtcgtatgggtaaagcgcttatttatcgtagagaaatccgataaataagaagcatcaaag

SEQ ID NO: 733 - DNA, 106 bp, Artificial Sequence
  scaffold variant
tctggcgcttttatctcattactttgagagccatcaccagcgactatgtcgtatgggtaaagcgcttatttatccagagaaatccgataaataagaagcatcaaag

SEQ ID NO: 734 - DNA, 106 bp, Artificial Sequence
  scaffold variant
cctggcgcttttatctcattactttgagagccatcaccagcgactatgtcgtatgggtaaagcgcttatttatcggagagaaaacgataaataagaagcatcaaag

SEQ ID NO: 735 - DNA, 108 bp, Artificial Sequence
  scaffold variant
tactggcgcttttatcctcattactttgagagccatcaccagcgactatgtcgtatgggtaaagcgcttatttatcggagagaaatcgataaataagaagcatcaaag

SEQ ID NO: 736 - DNA, 110 bp, Artificial Sequence
  scaffold variant
tactggcgcttttatctgcattactttgagagccatcaccagcgactatgtcgtatgggtaaagcgcttatttatcgggagagaaatccgataaataagaagcatcaaag

SEQ ID NO: 737 - DNA, 106 bp, Artificial Sequence
  scaffold variant
gctggcgcttttatctcattactttgagagccatcaccagcgactatgtcgtatgggtaaagcgcttattttcggagagaaatccgataaataagaagcatcaaag

SEQ ID NO: 738 - DNA, 107 bp, Artificial Sequence
  scaffold variant
atggcgcttttatctcattactttgagagccatcaccagcgactatgtcgtatgggtaaagcgcttatttatacggagagaaatccgataaataagaagcatcaaag

SEQ ID NO: 739 - DNA, 108 bp, Artificial Sequence
  scaffold variant
tactggcgcttttatcttcattactttgagagccatcaccagcgactatgtcgtatgggtaaagcgcttatttatcggcagaaatccgataaataagaagcatcaaag

SEQ ID NO: 740 - DNA, 108 bp, Artificial Sequence
  scaffold variant
tctggcgcttttattctcattactttgagagccatcaccagcgactatgtcgtatgggtaaagcgcttatttatcggagagaaatccgataaataagaagcatcaaag

SEQ ID NO: 741 - DNA, 105 bp, Artificial Sequence
  scaffold variant
tctggcgcttttatctcattactttgagagccatcaccagcgactatgtcgtatgggtaaagcgcttatttatcggagagatccgataaataagaagcatcaaag

SEQ ID NO: 742 - DNA, 106 bp, Artificial Sequence
  scaffold variant
cctggcgcttttatctcattactttgagagccatcaccagcgactatgtcgtatgggtaaagcgcttatttatcggagagaaatccgatagtaagaagcatcaaag

SEQ ID NO: 743 - DNA, 105 bp, Artificial Sequence
  scaffold variant
ctggcgcttttatctcattactttgagagccatcaccagcgactatgtcgtatgggtaaagcgcttattttcggagagaaatccgataaataagaagcatcaaag

SEQ ID NO: 744 - DNA, 110 bp, Artificial Sequence
  scaffold variant
tactggcgcttttatctctattactttgagagccatcaccagcgactatgtcgtatgggtaaagcgcttatttatcggagagaaatctcgataaataagaagcatcaaag

SEQ ID NO: 745 - DNA, 108 bp, Artificial Sequence
  scaffold variant
tacggcgcttttatctcattactttgagagccatcaccagcgactatgtcgtatgggtaaagcgcttatttatcggagagaaataccgataaataagaagcatcaaag

SEQ ID NO: 746 - DNA, 108 bp, Artificial Sequence
  scaffold variant
tacggcgcttttatctcattactttgagagccatcaccagcgactatgtcgtatgggtaaagcgcttatttatcgtgagagaaatccgataaataagaagcatcaaag

SEQ ID NO: 747 - DNA, 110 bp, Artificial Sequence
  scaffold variant
tactggcgcttttatctgcattactttgagagccatcaccagcgactatgtcgtatgggtaaagcgcttatttatacggagagaaatccgataaataagaagcatcaaag

SEQ ID NO: 748 - DNA, 108 bp, Artificial Sequence
  scaffold variant
tctggcgcttttatctcattactttgagagccatcaccagcgactatgtcgtatgggtaaagcgcttatttatctggagagaaatccgataaataagaagcatcaaag

SEQ ID NO: 749 - DNA, 108 bp, Artificial Sequence
  scaffold variant
tactggcgcttttattctcattactttgagagccatcaccagcgactatgtcgtatgggtaaagcgcttatttatccagagaaatccgataaataagaagcatcaaag

SEQ ID NO: 750 - DNA, 107 bp, Artificial Sequence
  scaffold variant
ctggcgcttttatctcattactttgagagccatcaccagcgactatgtcgtatgggtaaagcgcttatttatcggagagaaatccgaataaataagaagcatcaaag

SEQ ID NO: 751 - DNA, 108 bp, Artificial Sequence
  scaffold variant
tactggcgcttttattctcattactttgagagccatcaccagcgactatgtcgtatgggtaaagcgcttatttatcgagagaaatccgataaataagaagcatcaaag

SEQ ID NO: 752 - DNA, 110 bp, Artificial Sequence
  scaffold variant
tactggcgcttttattctcattactttgagagccatcaccagcgactatgtcgtatgggtaaagcgcttatttatcgtgagagaaatccgataaataagaagcatcaaag

SEQ ID NO: 753 - DNA, 108 bp, Artificial Sequence
  scaffold variant
cctggcgcttttatctcattactttgagagccatcaccagcgactatgtcgtatgggtaaagcgcttatttatcgagagagaaatccgataaataagaagcatcaaag

SEQ ID NO: 754 - DNA, 106 bp, Artificial Sequence
  scaffold variant
tctggcgcttttatctcattactttgagagccatcaccagcgactatgtcgtatgggtaaagcgcttatttatcggagagaaatccataaataagaagcatcaaag

SEQ ID NO: 755 - DNA, 108 bp, Artificial Sequence
  scaffold variant
tactggcgcttttatctcattactttgagagccatcaccagcgactatgtcgtattgggtaaagcgcttatttatcgggagaaatccgataaataagaagcatcaaag

SEQ ID NO: 756 - DNA, 105 bp, Artificial Sequence; identical to SEQ ID NO: 548
  scaffold variant

SEQ ID NO: 757 - DNA, 108 bp, Artificial Sequence
  scaffold variant
tactggcgcttttattctcattactttgagagccatcaccagcgactatgtcgtatgggtaaagcgcttatttatcggagagagtccgataaataagaagcatcaaag

SEQ ID NO: 758 - DNA, 108 bp, Artificial Sequence
  scaffold variant
cctggcgcttttatctcattactttgagagccatcaccagcgactatgtcgtatgggtaaagcgcttatttatcaggagagaaatccgataaataagaagcatcaaag

SEQ ID NO: 759 - DNA, 107 bp, Artificial Sequence; identical to SEQ ID NO: 484
  scaffold variant

SEQ ID NO: 760 - DNA, 106 bp, Artificial Sequence
  scaffold variant
tctggcgcttttatctcattactttgagagccatcaccagcgactatgtcgtatgggtaaagcgcttatttatcggagagtatccgataaataagaagcatcaaag

SEQ ID NO: 761 - DNA, 106 bp, Artificial Sequence
  scaffold variant
cctggcgcttttatctcattactttgagagccatcaccagcgactatgtcgtatgggtaaagcgcttatttatcggagagaaagcgataaataagaagcatcaaag

SEQ ID NO: 762 - DNA, 108 bp, Artificial Sequence
  scaffold variant
tacggcgcttttatctcattactttgagagccatcaccagcgactatgtcgtagtgggtaaagcgcttatttatcggagagaaatccgataaataagaagcatcaaag

SEQ ID NO: 763 - DNA, 108 bp, Artificial Sequence
  scaffold variant
actggcgcttttatctcattactttgagagccatcaccagcgactatgtcgtatgggtaaagcgcttatttatcggagagaaatgccgataaataagaagcatcaaag

SEQ ID NO: 764 - DNA, 107 bp, Artificial Sequence
  scaffold variant
tactggcgcttttatctcattactttagagagccatcaccagcgactatgtcgtatgggtaaagcgcttatttatcggagaaatccgataaataagaagcatcaaag

SEQ ID NO: 765 - DNA, 106 bp, Artificial Sequence
  scaffold variant
actggcgcttttatctcattactttgagagccatcaccagcgactatgtcgtatgggtaaagcgcttatttacggagagaaatccgataaataagaagcatcaaag

SEQ ID NO: 766 - DNA, 104 bp, Artificial Sequence
  scaffold variant
tggcgcttttatctcattactttgagagccatcaccagcgactatgtcgtatgggtaaagcgcttatttatcgagagaaatccgataaataagaagcatcaaag

SEQ ID NO: 767 - DNA, 108 bp, Artificial Sequence
  scaffold variant
tactggcgcttttattctcattactttgagagccatcaccagcgactatgtcgtatgggtaaagcgcttatttatcggagataatccgataaataagaagcatcaaag

SEQ ID NO: 768 - DNA, 108 bp, Artificial Sequence
  scaffold variant
tactggcgcttttatctgcattactttgagagccatcaccagcgactatgtcgtatgggtaaagcgcttattttcggagagaaatccgataaataagaagcatcaaag

SEQ ID NO: 769 - DNA, 107 bp, Artificial Sequence
  scaffold variant
ctggcgcttttatctcattactttgagagccatcaccagcgactatgtcgtatgggtaaagcgcttatttatcggcagagaaatccgataaataagaagcatcaaag

SEQ ID NO: 770 - DNA, 108 bp, Artificial Sequence
  scaffold variant
gctggcgcttttatctcattactttgagagccatcaccagcgactatgtcgtatgggtaaagcgcttatttatcggagagaaatccgtataaataagaagcatcaaag

SEQ ID NO: 771 - DNA, 108 bp, Artificial Sequence
  scaffold variant
tacggcgcttttatctcattactttgagagccatcaccagcgactatgtcgtatgggtaaagcgcttatttatcggagagaaatcacgataaataagaagcatcaaag

SEQ ID NO: 772 - DNA, 106 bp, Artificial Sequence
  scaffold variant
tacggcgcttttatctcattactttgagagccatcaccagcgactatgtcgtatgggtaaagcggtatttatcggagagaaatccgataaataagaagcatcaaag

SEQ ID NO: 773 - DNA, 110 bp, Artificial Sequence
  scaffold variant
tactggcgcttttatctcattactttcgagagccatcaccagcgactatgtcgtatgggtaaagcgcttatttatcggagagaaatgccgataaataagaagcatcaaag

SEQ ID NO: 774 - DNA, 108 bp, Artificial Sequence
  scaffold variant
tactggcgcttttatctgcattactttgagagccatcaccagcgactatgtcgtatgggtaaagcgcttatttatctagagaaatccgataaataagaagcatcaaag

SEQ ID NO: 775 - DNA, 105 bp, Artificial Sequence
  scaffold variant
atggcgcttttatctcattactttgagagccatcaccagcgactatgtcgtatgggtaaagcgcttatttatccagagaaatccgataaataagaagcatcaaag

SEQ ID NO: 776 - DNA, 105 bp, Artificial Sequence
  scaffold variant
ctggcgcttttatctcattactttgagagccatcaccagcgactatgtcgtatgggtaaagcgcttatttatcgtgagaaatccgataaataagaagcatcaaag

SEQ ID NO: 777 - DNA, 106 bp, Artificial Sequence
  scaffold variant
cctggcgcttttatctcattactttgagagccatcaccagcgactatgtcgtatgggtaaagcgcttatttatcggagagaaattgataaataagaagcatcaaag

SEQ ID NO: 778 - DNA, 105 bp, Artificial Sequence
  scaffold variant
tctggcgcttttatctcattactttgagagccatcaccagcgactatgtcgtatgggtaaagcgcttatttatcggagagaaccgataaataagaagcatcaaag

SEQ ID NO: 779 - DNA, 110 bp, Artificial Sequence
  scaffold variant
tactggcgcttttatctgcattactttgagagccatcaccagcgactatgtcgtatgggtaaagcgcttatttatcggagagaaatcgcgataaataagaagcatcaaag

SEQ ID NO: 780 - DNA, 108 bp, Artificial Sequence
  scaffold variant
cctggcgcttttatctcattactttgagagccatcaccagcgactatgtcgtatgggtaaagcgcttattatatcggagagaaatccgataaataagaagcatcaaag

SEQ ID NO: 781 - DNA, 105 bp, Artificial Sequence
  scaffold variant
cctggcgcttttatctcattactttgagagccatcaccagcgactatgtcgtatgggtaaagcgcttatttatcggagtaatccgataaataagaagcatcaaag

SEQ ID NO: 782 - DNA, 106 bp, Artificial Sequence
  scaffold variant
tctggcgcttttatctcattactttgagagccatcaccagcgactatgtcgtatgggtaaagcgcttatttatcgggagaaatccgataaataagaagcatcaaag

SEQ ID NO: 783 - DNA, 105 bp, Artificial Sequence
  scaffold variant
atggcgcttttatctcattactttgagagccatcaccagcgactatgtcgtatgggtaaagcgcttatttacggagagaaatccgataaataagaagcatcaaag

SEQ ID NO: 784 - DNA, 105 bp, Artificial Sequence
  scaffold variant
atggcgcttttatctcattactttgagagccatcaccagcgactatgtcgtatgggtaaagcgcttatttatcaagagaaatccgataaataagaagcatcaaag

SEQ ID NO: 785 - DNA, 109 bp, Artificial Sequence
  scaffold variant
tactggcgcttttatctcattactttgagagccatcaccagcgactatgtcgtatgggtaaagcgcttatttatgcggagagaaatccgataaataagaagcatcaaag

SEQ ID NO: 786 - DNA, 105 bp, Artificial Sequence
  scaffold variant
ctggcgcttttatctcattactttgagagccatcaccagcgactatgtcgtatgggtaaagcgcttatttatcggagagaaattgataaataagaagcatcaaag

SEQ ID NO: 787 - DNA, 110 bp, Artificial Sequence
  scaffold variant
tactggcgcttttatcttcattactttgagagccatcaccagcgactatgtcgtatgggtaaagcgcttatttatcaggagagaaatccgataaataagaagcatcaaag

SEQ ID NO: 788 - DNA, 106 bp, Artificial Sequence
  scaffold variant
cctggcgcttttatctcattactttgagagccatcaccagcgactatgtcgtatgggtaaagcgcttatttatcggagagagtccgataaataagaagcatcaaag

SEQ ID NO: 789 - DNA, 108 bp, Artificial Sequence
  scaffold variant
cctggcgcttttatctcattactttgagagccatcaccagcgactatgtcgtatgggtaaagcgcttatttatcggagagaaatccgagtaaataagaagcatcaaag

SEQ ID NO: 790 - DNA, 106 bp, Artificial Sequence
  scaffold variant
tactggcgcttttatctcattactttagagccatcaccagcgactatgtcgtatgggtaaagcgcttatttattgagagaaatccgataaataagaagcatcaaag

SEQ ID NO: 791 - DNA, 104 bp, Artificial Sequence
  scaffold variant
atggcgcttttatctcattactttgagagccatcaccagcgactatgtcgtatgggtaaagcgcttatttatcggagaaatccgataaataagaagcatcaaag

SEQ ID NO: 792 - DNA, 110 bp, Artificial Sequence
  scaffold variant
tactggcgcttttatctcattactttgagagccatcaccagcgactatgtcgtatgggtaaagcgcttatttatccggagagaaatcccgataaataagaagcatcaaag

SEQ ID NO: 793 - DNA, 106 bp, Artificial Sequence
  scaffold variant
tctggcgcttttatctcattactttgagagccatcaccagcgactatgtcgtatgggtaaagcgcttatttattgagagaaatccgataaataagaagcatcaaag

SEQ ID NO: 794 - DNA, 108 bp, Artificial Sequence
  scaffold variant
cctggcgcttttatctcattactttgagagccatcaccagcgactatgtcgtatgggtaaagcgcttattttatcggagagaaatccgataaataagaagcatcaaag

SEQ ID NO: 795 - DNA, 108 bp, Artificial Sequence
  scaffold variant
tactggcgcttttattctcattactttgagagccatcaccagcgactatgtcgtatgggtaaagcgcttatttatcggagagaaatccataaataagaagcatcaaag

SEQ ID NO: 796 - DNA, 108 bp, Artificial Sequence
  scaffold variant
cctggcgcttttatctcattactttgagagccatcaccagcgactatgtcgtatgggtaaagcgcttatttatcggagagaaaatccgataaataagaagcatcaaag

SEQ ID NO: 797 - DNA, 108 bp, Artificial Sequence
  scaffold variant
actggcgcttttatctcattactttgagagccatcaccagcgactatgtcgtatgggtaaagcgcttatttatcggtagagaaatccgataaataagaagcatcaaag

SEQ ID NO: 798 - DNA, 106 bp, Artificial Sequence
  scaffold variant
tactggcgcttttatctcattactttagagccatcaccagcgactatgtcgtatgggtaaagcgcttatttatctagagaaatccgataaataagaagcatcaaag

SEQ ID NO: 799 - DNA, 108 bp, Artificial Sequence
  scaffold variant
tactggcgcttttatctcattactttgagagccatcaccagcgactatgtcgtagtgggtaaagcgcttatttatcgagagaaatccgataaataagaagcatcaaag

SEQ ID NO: 800 - DNA, 108 bp, Artificial Sequence
  scaffold variant
cctggcgcttttatctcattactttgtagagccatcaccagcgactatgtcgtatgggtaaagcgcttatttatcggagagaaatccgataaataagaagcatcaaag

SEQ ID NO: 801 - DNA, 107 bp, Artificial Sequence
  scaffold variant
ctggcgcttttatctcattactttcgagagccatcaccagcgactatgtcgtatgggtaaagcgcttatttatcggagagaaatccgataaataagaagcatcaaag

SEQ ID NO: 802 - DNA, 110 bp, Artificial Sequence
  scaffold variant
tactggcgcttttattctcattactttgagagccatcaccagcgactatgtcgtagtgggtaaagcgcttatttatcggagagaaatccgataaataagaagcatcaaag

SEQ ID NO: 803 - DNA, 107 bp, Artificial Sequence
  scaffold variant
tacggcgcttttatctcattactttgagagccatcaccagcgactatgtcgtatgggtaaagcgcttatttttcggagagaaatccgataaataagaagcatcaaag

SEQ ID NO: 804 - DNA, 106 bp, Artificial Sequence
  scaffold variant
cctggcgcttttatctcattactttgagagccatcaccagcgactatgtcgtatgggtaaagcgcttatttatcggagagaatccgataaataagaagcatcaaag

SEQ ID NO: 805 - DNA, 106 bp, Artificial Sequence
  scaffold variant
gctggcgcttttatctcattactttgagagccatcaccagcgactatgtcgtatgggtaaagcgcttatttatcgtgagaaatccgataaataagaagcatcaaag

SEQ ID NO: 806 - DNA, 121 bp, Artificial Sequence
  scaffold variant
tactggcgcttttatctcattactttgctcattactttgagagccatcaccagcgactatgtcgtatgggtaaagcgcttatttatacggagagaaatccgataaataagaagcatcaaag

SEQ ID NO: 807 - DNA, 106 bp, Artificial Sequence
  scaffold variant
tctggcgcttttatctcattactttgagagccatcaccagcgactatgtcgtatgggtaaagcgcttatttatcggagagaatccgataaataagaagcatcaaag

SEQ ID NO: 808 - DNA, 108 bp, Artificial Sequence
  scaffold variant
gctggcgcttttatctcattactttgagagccatcaccagcgactatgtcgtatgggtaaagcgcttatttatcggagagaaatcacgataaataagaagcatcaaag

SEQ ID NO: 809 - DNA, 110 bp, Artificial Sequence
  scaffold variant
tactggcgcttttatctcattactttcgagagccatcaccagcgactatgtcgtatgggtaaagcgcttatttactcggagagaaatccgataaataagaagcatcaaag

SEQ ID NO: 810 - DNA, 107 bp, Artificial Sequence
  scaffold variant
tactggcgcttttatctcattactttgagagccatcaccagcgactatgtcgtatgggtaaagcgcttatttatcgcgagaaatccgataaataagaagcatcaaag

SEQ ID NO: 811 - DNA, 110 bp, Artificial Sequence
  scaffold variant
tactggcgcttttattctcattactttgagagccatcaccagcgactatgtcgtatgggtaaagcgcttattatatcggagagaaatccgataaataagaagcatcaaag

SEQ ID NO: 812 - DNA, 108 bp, Artificial Sequence
  scaffold variant
tactggcgcttttatcttcattactttgagagccatcaccagcgactatgtcgtatgggtaaagcgcttatttatcgggagaaatccgataaataagaagcatcaaag

SEQ ID NO: 813 - DNA, 106 bp, Artificial Sequence
  scaffold variant
tggcgcttttatctcattactttgagagccatcaccagcgactatgtcgtatgggtaaagcgcttatttatccggagagaaatccgataaataagaagcatcaaag

SEQ ID NO: 814 - DNA, 108 bp, Artificial Sequence
  scaffold variant
tctggcgcttttatctcattactttgagagccatcaccagcgactatgtcgtatgggtaaagcgcttatttatcgggagagaaatccgataaataagaagcatcaaag

SEQ ID NO: 815 - DNA, 108 bp, Artificial Sequence
  scaffold variant
actggcgcttttatctcattactttgagagccatcaccagcgactatgtcgtatgggtaaagcgcttatttatctggagagaaatccgataaataagaagcatcaaag

SEQ ID NO: 816 - DNA, 106 bp, Artificial Sequence
  scaffold variant
tggcgcttttatctcattactttgagagccatcaccagcgactatgtcgtatgggtaaagcgcttatttatcggagagaaatcgcgataaataagaagcatcaaag

SEQ ID NO: 817 - DNA, 108 bp, Artificial Sequence
  scaffold variant
actggcgcttttatctcattactttgagagccatcaccagcgactatgtcgtatgggtaaagcgcttatttatcggagagacaatccgataaataagaagcatcaaag

SEQ ID NO: 818 - DNA, 106 bp, Artificial Sequence
  scaffold variant
cctggcgcttttatctcattactttgagagccatcaccagcgactatgtcgtatgggtaaagcgcttatttatagagagaaatccgataaataagaagcatcaaag

SEQ ID NO: 819 - DNA, 108 bp, Artificial Sequence
  scaffold variant
gctggcgcttttatctcattactttgagagccatcaccagcgactatgtcgtatgggtaaagcgcttatttatctggagagaaatccgataaataagaagcatcaaag

SEQ ID NO: 820 - DNA, 108 bp, Artificial Sequence
  scaffold variant
tactggcgcttttatctcattactttgcagagccatcaccagcgactatgtcgtatgggtaaagcgcttatttatcggagagaaatccataaataagaagcatcaaag

SEQ ID NO: 821 - DNA, 108 bp, Artificial Sequence
  scaffold variant
tctggcgcttttatctcattactttgagagccatcaccagcgactatgtcgtatgggtaaagcgcttatttaatcggagagaaatccgataaataagaagcatcaaag

SEQ ID NO: 822 - DNA, 104 bp, Artificial Sequence
  scaffold variant
tggcgcttttatctcattactttgagagccatcaccagcgactatgtcgtatgggtaaagcgcttatttatctagagaaatccgataaataagaagcatcaaag

SEQ ID NO: 823 - DNA, 108 bp, Artificial Sequence
  scaffold variant
tactggcgcttttatctcattactttgagagccatcaccagcgactatgtcgtatgggtaaagcgcttatttatcgcagagaaatccgataaataagaagcatcaaag

SEQ ID NO: 824 - DNA, 110 bp, Artificial Sequence
  scaffold variant
tactggcgcttttatcttcattactttgagagccatcaccagcgactatgtcgtatgggtaaagcgcttatttatcgggagagaaatccgataaataagaagcatcaaag

SEQ ID NO: 825 - DNA, 108 bp, Artificial Sequence
  scaffold variant
tactggcgcttttatcttcattactttgagagccatcaccagcgactatgtcgtatgggtaaagcgcttatttatcggagagaaatcgataaataagaagcatcaaag

SEQ ID NO: 826 - DNA, 106 bp, Artificial Sequence
  scaffold variant
cctggcgcttttatctcattactttgagagccatcaccagcgactatgtcgtatgggtaaagcgcttatttatcggagcaaatccgataaataagaagcatcaaag

SEQ ID NO: 827 - DNA, 108 bp, Artificial Sequence
  scaffold variant
tactggcgcttttattctcattactttgagagccatcaccagcgactatgtcgtatgggtaaagcgcttatttatcggagagaaatccgaaaataagaagcatcaaag

SEQ ID NO: 828 - DNA, 108 bp, Artificial Sequence
  scaffold variant
ttactggcgcttttatctcattactttgagagccatcaccagcgactatgtcgtatgggtaaagcgcttatttatcgagagaaatccgataaataagaagcatcaaag

SEQ ID NO: 829 - DNA, 107 bp, Artificial Sequence
  scaffold variant
atggcgcttttatctcattactttgagagccatcaccagcgactatgtcgtatgggtaaagcgcttatttatcggagagaaatcccgataaataagaagcatcaaag

SEQ ID NO: 830 - DNA, 108 bp, Artificial Sequence
  scaffold variant
actggcgcttttatctcattactttgagagccatcaccagcgactatgtcgtatgggtaaagcgcttatttatcggagagaaataccgataaataagaagcatcaaag

SEQ ID NO: 831 - DNA, 106 bp, Artificial Sequence
  scaffold variant
tctggcgcttttatctcattactttgagagccatcaccagcgactatgtcgtatgggtaaagcgcttatttatcggcagaaatccgataaataagaagcatcaaag

SEQ ID NO: 832 - DNA, 104 bp, Artificial Sequence
  scaffold variant
tggcgcttttatctcattactttgagagccatcaccagcgactatgtcgtatgggtaaagcgcttatttatcaagagaaatccgataaataagaagcatcaaag

SEQ ID NO: 833 - DNA, 110 bp, Artificial Sequence
  scaffold variant
tactggcgcttttatctcattactttgcagagccatcaccagcgactatgtcgtatgggtaaagcgcttatttatccggagagaaatccgataaataagaagcatcaaag

SEQ ID NO: 834 - DNA, 105 bp, Artificial Sequence
  scaffold variant
ctggcgcttttatctcattactttgagagccatcaccagcgactatgtcgtatgggtaaagcgcttatttacggagagaaatccgataaataagaagcatcaaag

SEQ ID NO: 835 - DNA, 106 bp, Artificial Sequence
  scaffold variant
tctggcgcttttatctcattactttgagagccatcaccagcgactatgtcgtatgggtaaagcgcttattttcggagagaaatccgataaataagaagcatcaaag

SEQ ID NO: 836 - DNA, 106 bp, Artificial Sequence
  scaffold variant
cctggcgcttttatctcattactttgagagccatcaccagcgactatgtcgtatgggtaaagcgcttatttatcggcagaaatccgataaataagaagcatcaaag

SEQ ID NO: 837 - DNA, 104 bp, Artificial Sequence; identical to SEQ ID NO: 766
  scaffold variant

SEQ ID NO: 838 - DNA, 110 bp, Artificial Sequence
  scaffold variant
tactggcgcttttatctctattactttgagagccatcaccagcgactatgtcgtatgggtaaagcgcttatttatcggcagagaaatccgataaataagaagcatcaaag

SEQ ID NO: 839 - DNA, 108 bp, Artificial Sequence
  scaffold variant
tctggcgcttttatctcattactttgagagccatcaccagcgactatgtcgtattgggtaaagcgcttatttatcggagagaaatccgataaataagaagcatcaaag

SEQ ID NO: 840 - DNA, 108 bp, Artificial Sequence
  scaffold variant
tactggcgcttttatcctcattactttgagagccatcaccagcgactatgtcgtatgggtaaagcgcttatttatcggagataatccgataaataagaagcatcaaag

SEQ ID NO: 841 - DNA, 108 bp, Artificial Sequence
  scaffold variant
tactggcgcttttatctcattactttcgagagccatcaccagcgactatgtcgtatgggtaaagcgcttatttatcggaagaaatccgataaataagaagcatcaaag

SEQ ID NO: 842 - DNA, 108 bp, Artificial Sequence
  scaffold variant
tctggcgcttttatctcattactttgagagccatcaccagcgactatgtcgtatgggtaaagcgcttatttatcggcagagaaatccgataaataagaagcatcaaag

SEQ ID NO: 843 - DNA, 105 bp, Artificial Sequence
  scaffold variant
ctggcgcttttatctcattactttgagagccatcaccagcgactatgtcgtatgggtaaagcgcttatttatcggagagaaagcgataaataagaagcatcaaag

SEQ ID NO: 844 - DNA, 110 bp, Artificial Sequence
  scaffold variant
tactggcgcttttatctgcattactttgagagccatcaccagcgactatgtcgtatgggtaaagcgcttatttatcggagagaaatcccgataaataagaagcatcaaag

SEQ ID NO: 845 - DNA, 106 bp, Artificial Sequence
  scaffold variant
cctggcgcttttatctcattactttgagagccatcaccagcgactatgtcgtatgggtaaagcgcttatttatcggtagaaatccgataaataagaagcatcaaag

SEQ ID NO: 846 - DNA, 108 bp, Artificial Sequence
  scaffold variant
tctggcgcttttatctcattactttgagagccatcaccagcgactatgtcgtatgggtaaagcgcttattttatcggagagaaatccgataaataagaagcatcaaag

SEQ ID NO: 847 - DNA, 109 bp, Artificial Sequence
  scaffold variant
tactggcgcttttatctcattactttgagagccatcaccagcgactatgtcgtatgggtaaagcgcttatttatcggcagagaaatccgataaataagaagcatcaaag

SEQ ID NO: 848 - DNA, 106 bp, Artificial Sequence
  scaffold variant
actggcgcttttatctcattactttgagagccatcaccagcgactatgtcgtatgggtaaagcgcttatttatcggagaggatccgataaataagaagcatcaaag

SEQ ID NO: 849 - DNA, 108 bp, Artificial Sequence
  scaffold variant
tactggcgcttttatctcattactttcgagagccatcaccagcgactatgtcgtatgggtaaagcgcttatttatcggagacaatccgataaataagaagcatcaaag

SEQ ID NO: 850 - DNA, 107 bp, Artificial Sequence
  scaffold variant
tctggcgcttttatctcattactttgagagccatcaccagcgactatgtcgtatgggtaaagcgcttatttatcggagagaaatccggtaaataagaagcatcaaag

SEQ ID NO: 851 - DNA, 108 bp, Artificial Sequence
  scaffold variant
gctggcgcttttatctcattactttgagagccatcaccagcgactatgtcgtattgggtaaagcgcttatttatcggagagaaatccgataaataagaagcatcaaag

SEQ ID NO: 852 - DNA, 106 bp, Artificial Sequence; identical to SEQ ID NO: 813
  scaffold variant

SEQ ID NO: 853 - DNA, 108 bp, Artificial Sequence
  scaffold variant
cctggcgcttttatctcattactttgagagccatcaccagcgactatgtcgtatgggtaaagcgcttatttatcggagagtaaatccgataaataagaagcatcaaag

SEQ ID NO: 854 - DNA, 106 bp, Artificial Sequence; identical to SEQ ID NO: 430
  scaffold variant

SEQ ID NO: 855 - DNA, 110 bp, Artificial Sequence
  scaffold variant
tactggcgcttttatcttcattactttgagagccatcaccagcgactatgtcgtattgggtaaagcgcttatttatcggagagaaatccgataaataagaagcatcaaag

SEQ ID NO: 856 - DNA, 108 bp, Artificial Sequence
  scaffold variant
tactggcgcttttatcttcattactttgagagccatcaccagcgactatgtcgtatgggtaaagcgcttatttatcggagagtatccgataaataagaagcatcaaag

SEQ ID NO: 857 - DNA, 110 bp, Artificial Sequence
  scaffold variant
tactggcgcttttatcttcattactttgagagccatcaccagcgactatgtcgtatgggtaaagcgcttatttactcggagagaaatccgataaataagaagcatcaaag

SEQ ID NO: 858 - DNA, 108 bp, Artificial Sequence
  scaffold variant
gctggcgcttttatctcattactttgagagccatcaccagcgactatgtcgtatgggtaaagcgcttatttagtcggagagaaatccgataaataagaagcatcaaag

SEQ ID NO: 859 - DNA, 106 bp, Artificial Sequence
  scaffold variant
actggcgcttttatctcattactttgagagccatcaccagcgactatgtcgtatgggtaaagcgcttatttatcggagagaagccgataaataagaagcatcaaag

SEQ ID NO: 860 - DNA, 105 bp, Artificial Sequence
  scaffold variant
atggcgcttttatctcattactttgagagccatcaccagcgactatgtcgtatgggtaaagcgcttatttatcggagagaaatcgataaataagaagcatcaaag

SEQ ID NO: 861 - DNA, 105 bp, Artificial Sequence
  scaffold variant
atggcgcttttatctcattactttgagagccatcaccagcgactatgtcgtatgggtaaagcgcttatttatcggagagaaatccataaataagaagcatcaaag

SEQ ID NO: 862 - DNA, 105 bp, Artificial Sequence; identical to SEQ ID NO: 453
  scaffold variant

SEQ ID NO: 863 - DNA, 108 bp, Artificial Sequence
  scaffold variant
tactggcgcttttatcttcattactttgagagccatcaccagcgactatgtcgtatgggtaaagcgcttatttatcggagataatccgataaataagaagcatcaaag

SEQ ID NO: 864 - DNA, 108 bp, Artificial Sequence
  scaffold variant
tactggcgcttttatctcattactttgcagagccatcaccagcgactatgtcgtatgggtaaagcgcttatttatcggagagaaaacgataaataagaagcatcaaag

SEQ ID NO: 865 - DNA, 105 bp, Artificial Sequence
  scaffold variant
tacggcgcttttatctcattactttgagagccatcaccagcgactatgtcgtatgggtaaagcgtatttatcggagagaaatccgataaataagaagcatcaaag

SEQ ID NO: 866 - DNA, 105 bp, Artificial Sequence
  scaffold variant
ctggcgcttttatctcattactttgagagccatcaccagcgactatgtcgtatgggtaaagcggtatttatcggagagaaatccgataaataagaagcatcaaag

SEQ ID NO: 867 - DNA, 110 bp, Artificial Sequence
  scaffold variant
tactggcgcttttatctcattactttgagagccatcaccagcgactatgtcgtatgggtaaagcgcttatttatgcggagagaaatctcgataaataagaagcatcaaag

SEQ ID NO: 868 - DNA, 106 bp, Artificial Sequence
  scaffold variant
cctggcgcttttatctcattactttgagagccatcaccagcgactatgtcgtatgggtaaagcgcttatttatcggagagcatccgataaataagaagcatcaaag

SEQ ID NO: 869 - DNA, 108 bp, Artificial Sequence
  scaffold variant
gctggcgcttttattctcattactttgagagccatcaccagcgactatgtcgtatgggtaaagcgcttatttatcggagagaaatccgataaataagaagcatcaaag

SEQ ID NO: 870 - DNA, 107 bp, Artificial Sequence
  scaffold variant
cctggcgcttttatctcattactttgagagccatcaccagcgactatgtcgtatgggtaaagcgcttatttatcggagtgaaatccgataaataagaagcatcaaag

SEQ ID NO: 871 - DNA, 108 bp, Artificial Sequence
  scaffold variant
tacggcgcttttatctcattactttgagagccatcaccagcgactatgtcgtatgggtaaagcgcttatttaatcggagagaaatccgataaataagaagcatcaaag

SEQ ID NO: 872 - DNA, 106 bp, Artificial Sequence
  scaffold variant
tacggcgcttttatctcattactttgagagccatcaccagcgactatgtcgtatgggtaaagcgcttatttatcggagagaaatccggaaataagaagcatcaaag

SEQ ID NO: 873 - DNA, 106 bp, Artificial Sequence
  scaffold variant
tactggcgcttttattcattactttgagagccatcaccagcgactatgtcgtatgggtaaagcgcttatttatcaagagaaatccgataaataagaagcatcaaag

SEQ ID NO: 874 - DNA, 108 bp, Artificial Sequence
  scaffold variant
tacggcgcttttatctcattactttgagagccatcaccagcgactatgtcgtatgggtaaagcgcttatttagtcggagagaaatccgataaataagaagcatcaaag

SEQ ID NO: 875 - DNA, 108 bp, Artificial Sequence
  scaffold variant
tactggcgcttttatctcgattactttgagagccatcaccagcgactatgtcgtatgggtaaagcgcttatttatctagagaaatccgataaataagaagcatcaaag

SEQ ID NO: 876 - DNA, 106 bp, Artificial Sequence
  scaffold variant
gctggcgcttttatctcattactttgagagccatcaccagcgactatgtcgtatgggtaaagcgcttatttatcgcgagaaatccgataaataagaagcatcaaag

SEQ ID NO: 877 - DNA, 106 bp, Artificial Sequence
  scaffold variant
tctggcgcttttatctcattactttgagagccatcaccagcgactatgtcgtatgggtaaagcgcttatttacggagagaaatccgataaataagaagcatcaaag

SEQ ID NO: 878 - DNA, 107 bp, Artificial Sequence
  scaffold variant
tactggcgcttttatctcattactttgagagccatcaccagcgactatgtcgtatgggtaaagcgcttatttatcgagagaaatccgataaataagaagcatcaaag

SEQ ID NO: 879 - DNA, 108 bp, Artificial Sequence
  scaffold variant
tactggcgcttttatcttcattactttgagagccatcaccagcgactatgtcgtatgggtaaagcgcttattttcggagagaaatccgataaataagaagcatcaaag

SEQ ID NO: 880 - DNA, 107 bp, Artificial Sequence
  scaffold variant
cctggcgcttttatctcattactttgagagccatcaccagcgactatgtcgtatgggtaaagcgcttatttatcggcgagaaatccgataaataagaagcatcaaag

SEQ ID NO: 881 - DNA, 110 bp, Artificial Sequence
  scaffold variant
tactggcgcttttatctcattactttgagagccatcaccagcgactatgtcgtattgggtaaagcgcttatttatcggagagaaatcccgataaataagaagcatcaaag

SEQ ID NO: 882 - DNA, 109 bp, Artificial Sequence
  scaffold variant
tactggcgcttttatctcattactttgagagccatcaccagcgactatgtcgtatgggtaaagcgcttatttatcaggagagaaatccgataaataagaagcatcaaag

SEQ ID NO: 883 - DNA, 108 bp, Artificial Sequence
  scaffold variant
cctggcgcttttatctgcattactttgagagccatcaccagcgactatgtcgtatgggtaaagcgcttatttatcggagagaaatccgataaataagaagcatcaaag

SEQ ID NO: 884 - DNA, 109 bp, Artificial Sequence; identical to SEQ ID NO: 563
  scaffold variant

SEQ ID NO: 885 - DNA, 108 bp, Artificial Sequence
  scaffold variant
tactggcgcttttatcctcattactttgagagccatcaccagcgactatgtcgtatgggtaaagcgcttatttatctagagaaatccgataaataagaagcatcaaag

SEQ ID NO: 886 - DNA, 110 bp, Artificial Sequence
  scaffold variant
ttactggcgcttttatctcattactttgagagccatcaccagcgactatgtcgtatgggtaaagcgcttatttatcggagagaaatcgcgataaataagaagcatcaaag

SEQ ID NO: 887 - DNA, 108 bp, Artificial Sequence
  scaffold variant
tctggcgcttttatcttcattactttgagagccatcaccagcgactatgtcgtatgggtaaagcgcttatttatcggagagaaatccgataaataagaagcatcaaag

SEQ ID NO: 888 - DNA, 108 bp, Artificial Sequence
  scaffold variant
actggcgcttttatctcattactttgagagccatcaccagcgactatgtcgtatgggtaaagcgcttatttactcggagagaaatccgataaataagaagcatcaaag

SEQ ID NO: 889 - DNA, 108 bp, Artificial Sequence
  scaffold variant
tactggcgcttttattctcattactttgagagccatcaccagcgactatgtcgtatgggtaaagcgcttatttgcggagagaaatccgataaataagaagcatcaaag

SEQ ID NO: 890 - DNA, 108 bp, Artificial Sequence
  scaffold variant
gctggcgcttttatctcattactttgagagccatcaccagcgactatgtcgtatgggtaaagcgcttatttactcggagagaaatccgataaataagaagcatcaaag

SEQ ID NO: 891 - DNA, 109 bp, Artificial Sequence; identical to SEQ ID NO: 785
  scaffold variant

SEQ ID NO: 892 - DNA, 108 bp, Artificial Sequence
  scaffold variant
tactggcgcttttaatctcattactttgagagccatcaccagcgactatgtcgtatgggtaaagcgcttatttatctagagaaatccgataaataagaagcatcaaag

SEQ ID NO: 893 - DNA, 106 bp, Artificial Sequence
  scaffold variant
tctggcgcttttatctcattactttgagagccatcaccagcgactatgtcgtatgggtaaagcgcttatttatcgtgagaaatccgataaataagaagcatcaaag

SEQ ID NO: 894 - DNA, 108 bp, Artificial Sequence
  scaffold variant
gctggcgcttttatctcattactttgagagccatcaccagcgactatgtcgtatgggtaaagcgcttatttatcgggagagaaatccgataaataagaagcatcaaag

SEQ ID NO: 895 - DNA, 106 bp, Artificial Sequence
  scaffold variant
tctggcgcttttatctcattactttgagagccatcaccagcgactatgtcgtatgggtaaagcgcttatttatcggagagaaatccgtaaataagaagcatcaaag

SEQ ID NO: 896 - DNA, 105 bp, Artificial Sequence
  scaffold variant
ctggcgcttttatctcattactttgagagccatcaccagcgactatgtcgtatgggtaaagcgcttattatcggagagaaatccgataaataagaagcatcaaag

SEQ ID NO: 897 - DNA, 109 bp, Artificial Sequence; identical to SEQ ID NO: 785
  scaffold variant

SEQ ID NO: 898 - DNA, 108 bp, Artificial Sequence
  scaffold variant
tactggcgcttttatctctattactttgagagccatcaccagcgactatgtcgtatgggtaaagcgcttatttatcaagagaaatccgataaataagaagcatcaaag

SEQ ID NO: 899 - DNA, 108 bp, Artificial Sequence
  scaffold variant
tactggcgcttttatctcattactttgtagagccatcaccagcgactatgtcgtatgggtaaagcgcttatttattgagagaaatccgataaataagaagcatcaaag

SEQ ID NO: 900 - DNA, 107 bp, Artificial Sequence
  scaffold variant
ctggcgcttttatctcattactttagagagccatcaccagcgactatgtcgtatgggtaaagcgcttatttatcggagagaaatccgataaataagaagcatcaaag

SEQ ID NO: 901 - DNA, 105 bp, Artificial Sequence
  scaffold variant
ctggcgcttttatctcattactttgagagccatcaccagcgactatgtcgtatgggtaaagcgcttatttatcgcgagaaatccgataaataagaagcatcaaag

SEQ ID NO: 902 - DNA, 105 bp, Artificial Sequence
  scaffold variant
tacggcgcttttatctcattactttgagagccatcaccagcgactatgtcgtatgggtaaagcgcttatttatcggagtaatccgataaataagaagcatcaaag

SEQ ID NO: 903 - DNA, 106 bp, Artificial Sequence
  scaffold variant
tacggcgcttttatctcattactttgagagccatcaccagcgactatgtcgtatgggtaaagcgcttatttatcgcgagaaatccgataaataagaagcatcaaag

SEQ ID NO: 904 - DNA, 108 bp, Artificial Sequence
  scaffold variant
gctggcgcttttatctcattactttgagagccatcaccagcgactatgtcgtatgggtaaagcgcttatttatcggagagaaatcgcgataaataagaagcatcaaag

SEQ ID NO: 905 - DNA, 105 bp, Artificial Sequence; identical to SEQ ID NO: 424
  scaffold variant

SEQ ID NO: 906 - DNA, 108 bp, Artificial Sequence
  scaffold variant
tacggcgcttttatctcattactttcgagagccatcaccagcgactatgtcgtatgggtaaagcgcttatttatcggagagaaatccgataaataagaagcatcaaag

SEQ ID NO: 907 - DNA, 106 bp, Artificial Sequence
  scaffold variant
tctggcgcttttatctcattactttgagagccatcaccagcgactatgtcgtatgggtaaagcgcttatttatcggaggaaatccgataaataagaagcatcaaag

SEQ ID NO: 908 - DNA, 109 bp, Artificial Sequence; identical to SEQ ID NO: 785
  scaffold variant

SEQ ID NO: 909 - DNA, 105 bp, Artificial Sequence
  scaffold variant
atggcgcttttatctcattactttgagagccatcaccagcgactatgtcgtatgggtaaagcgcttatttattgagagaaatccgataaataagaagcatcaaag

SEQ ID NO: 910 - DNA, 106 bp, Artificial Sequence
  scaffold variant
tctggcgcttttatctcattactttgagagccatcaccagcgactatgtcgtatgggtaaagcgcttatttatcggtagaaatccgataaataagaagcatcaaag

SEQ ID NO: 911 - DNA, 106 bp, Artificial Sequence
  scaffold variant
tacggcgcttttatctcattactttgagagccatcaccagcgactatgtcgtatgggtaaagcgcttatttatcggagaggatccgataaataagaagcatcaaag

SEQ ID NO: 912 - DNA, 105 bp, Artificial Sequence
  scaffold variant
gctggcgcttttatctcattactttgagagccatcaccagcgactatgtcgtatgggtaaagcgcttatttatcggagaaatccgataaataagaagcatcaaag

SEQ ID NO: 913 - DNA, 105 bp, Artificial Sequence
  scaffold variant
ctggcgcttttatctcattactttgagagccatcaccagcgactatgtcgtatgggtaaagcgcttatttatcggagagaaatccgtaaataagaagcatcaaag

SEQ ID NO: 914 - DNA, 107 bp, Artificial Sequence
  scaffold variant
actggcgcttttatctcattactttgagagccatcaccagcgactatgtcgtatgggtaaagcgcttatttctcggagagaaatccgataaataagaagcatcaaag

SEQ ID NO: 915 - DNA, 108 bp, Artificial Sequence
  scaffold variant
gctggcgcttttatctcattactttgagagccatcaccagcgactatgtcgtatgggtaaagcgcttatttatcggagagaaatcctgataaataagaagcatcaaag

SEQ ID NO: 916 - DNA, 104 bp, Artificial Sequence; identical to SEQ ID NO: 832
  scaffold variant

SEQ ID NO: 917 - DNA, 106 bp, Artificial Sequence
  scaffold variant
actggcgcttttatctcattactttgagagccatcaccagcgactatgtcgtatgggtaaagcgcttatttatcggaggaaatccgataaataagaagcatcaaag

SEQ ID NO: 918 - DNA, 106 bp, Artificial Sequence
  scaffold variant
tacggcgcttttatctcattactttgagagccatcaccagcgactatgtcgtatgggtaaagcgcttatttatcggagtaaatccgataaataagaagcatcaaag

SEQ ID NO: 919 - DNA, 110 bp, Artificial Sequence
  scaffold variant
tactggcgcttttattctcattactttgagagccatcaccagcgactatgtcgtatgggtaaagcgcttatttatcggcagagaaatccgataaataagaagcatcaaag

SEQ ID NO: 920 - DNA, 108 bp, Artificial Sequence
  scaffold variant
ttactggcgcttttatctcattactttgagagccatcaccagcgactatgtcgtatgggtaaagcgcttatttatctagagaaatccgataaataagaagcatcaaag

SEQ ID NO: 921 - DNA, 105 bp, Artificial Sequence
  scaffold variant
ctggcgcttttatctcattactttgagagccatcaccagcgactatgtcgtatgggtaaagcgcttatttatcggagcaaatccgataaataagaagcatcaaag

SEQ ID NO: 922 - DNA, 110 bp, Artificial Sequence
  scaffold variant
tactggcgcttttattctcattactttgagagccatcaccagcgactatgtcgtatgggtaaagcgcttatttatcggagagaaatccgcataaataagaagcatcaaag

SEQ ID NO: 923 - DNA, 108 bp, Artificial Sequence
  scaffold variant
gctggcgcttttatctcattactttgcagagccatcaccagcgactatgtcgtatgggtaaagcgcttatttatcggagagaaatccgataaataagaagcatcaaag

SEQ ID NO: 924 - DNA, 108 bp, Artificial Sequence
  scaffold variant
tactggcgcttttatctcgattactttgagagccatcaccagcgactatgtcgtatgggtaaagcgcttatttatcgagagaaatccgataaataagaagcatcaaag

SEQ ID NO: 925 - DNA, 105 bp, Artificial Sequence
  scaffold variant
ctggcgcttttatctcattactttgagagccatcaccagcgactatgtcgtatgggtaaagcgcttatttatccagagaaatccgataaataagaagcatcaaag

SEQ ID NO: 926 - DNA, 106 bp, Artificial Sequence
  scaffold variant
tacggcgcttttatctcattactttgagagccatcaccagcgactatgtcgtatgggtaaagcgcttattttcggagagaaatccgataaataagaagcatcaaag

SEQ ID NO: 927 - DNA, 110 bp, Artificial Sequence
  scaffold variant
tactggcgcttttatcctcattactttgagagccatcaccagcgactatgtcgtatgggtaaagcgcttatttatcggagagaaatctcgataaataagaagcatcaaag

SEQ ID NO: 928 - DNA, 107 bp, Artificial Sequence
  scaffold variant
cctggcgcttttatctcattactttgagagccatcaccagcgactatgtcgtatgggtaaagcgcttatttatcggagagaaatcagataaataagaagcatcaaag

SEQ ID NO: 929 - DNA, 108 bp, Artificial Sequence
  scaffold variant
tctggcgcttttatctcattactttgagagccatcaccagcgactatgtcgtatgggtaaagcgcttatttatcggagagaaatcccgataaataagaagcatcaaag

SEQ ID NO: 930 - DNA, 106 bp, Artificial Sequence
  scaffold variant
tctggcgcttttatctcattactttgagagccatcaccagcgactatgtcgtatgggtaaagcgcttatttatcggagcaaatccgataaataagaagcatcaaag

SEQ ID NO: 931 - DNA, 110 bp, Artificial Sequence
  scaffold variant
tactggcgcttttatcttcattactttgagagccatcaccagcgactatgtcgtatgggtaaagcgcttatttatcgcgagagaaatccgataaataagaagcatcaaag

SEQ ID NO: 932 - DNA, 108 bp, Artificial Sequence
  scaffold variant
actggcgcttttatctcattactttgagagccatcaccagcgactatgtcgtatgggtaaagcgcttatttatcggagagaaaatccgataaataagaagcatcaaag

SEQ ID NO: 933 - DNA, 106 bp, Artificial Sequence
  scaffold variant
tctggcgcttttatctcattactttgagagccatcaccagcgactatgtcgtatgggtaaagcgcttatttatcggagagaaatccggaaataagaagcatcaaag

SEQ ID NO: 934 - DNA, 106 bp, Artificial Sequence
  scaffold variant
cctggcgcttttatctcattactttgagagccatcaccagcgactatgtcgtatgggtaaagcgcttatttatcggagagactccgataaataagaagcatcaaag

SEQ ID NO: 935 - DNA, 106 bp, Artificial Sequence
  scaffold variant
tacggcgcttttatctcattactttgagagccatcaccagcgactatgtcgtatgggtaaagcgttatttatcggagagaaatccgataaataagaagcatcaaag

SEQ ID NO: 936 - DNA, 105 bp, Artificial Sequence
  scaffold variant
ctggcgcttttatctcattactttgagagccatcaccagcgactatgtcgtatgggtaaagcgcttatttatcggagagaaaacgataaataagaagcatcaaag

SEQ ID NO: 937 - DNA, 108 bp, Artificial Sequence
  scaffold variant
gctggcgcttttatctcattactttgagagccatcaccagcgactatgtcgtatgggtaaagcgcttatttatccggagagaaatccgataaataagaagcatcaaag

SEQ ID NO: 938 - DNA, 110 bp, Artificial Sequence
  scaffold variant
tactggcgcttttatctcattactttgagagccatcaccagcgactatgtcgtagtgggtaaagcgcttatttatcgggagagaaatccgataaataagaagcatcaaag

SEQ ID NO: 939 - DNA, 108 bp, Artificial Sequence
  scaffold variant
tactggcgcttttatctgcattactttgagagccatcaccagcgactatgtcgtatgggtaaagcgcttatttatcggagataatccgataaataagaagcatcaaag

SEQ ID NO: 940 - DNA, 110 bp, Artificial Sequence
  scaffold variant
tactggcgcttttatcctcattactttgagagccatcaccagcgactatgtcgtatgggtaaagcgcttatttatctggagagaaatccgataaataagaagcatcaaag

SEQ ID NO: 941 - DNA, 108 bp, Artificial Sequence
  scaffold variant
tacggcgcttttatctcattactttagagagccatcaccagcgactatgtcgtatgggtaaagcgcttatttatcggagagaaatccgataaataagaagcatcaaag

SEQ ID NO: 942 - DNA, 110 bp, Artificial Sequence
  scaffold variant
tactggcgcttttatcttcattactttgagagccatcaccagcgactatgtcgtatgggtaaagcgcttatttatcggagagaaatcctgataaataagaagcatcaaag

SEQ ID NO: 943 - DNA, 108 bp, Artificial Sequence
  scaffold variant
tactggcgcttttatcctcattactttgagagccatcaccagcgactatgtcgtatgggtaaagcgcttatttatggagagaaatccgataaataagaagcatcaaag

SEQ ID NO: 944 - DNA, 106 bp, Artificial Sequence
  scaffold variant
tacggcgcttttatctcattactttgagagccatcaccagcgactatgtcgtatgggtaaagcgcttatttatcggagagaaatccctaaataagaagcatcaaag

SEQ ID NO: 945 - DNA, 106 bp, Artificial Sequence
  scaffold variant
tctggcgcttttatctcattactttgagagccatcaccagcgactatgtcgtatgggtaaagcgttatttatcggagagaaatccgataaataagaagcatcaaag

SEQ ID NO: 946 - DNA, 110 bp, Artificial Sequence
  scaffold variant
tactggcgcttttatctcattactttcgagagccatcaccagcgactatgtcgtatgggtaaagcgcttatttatcgagagagaaatccgataaataagaagcatcaaag

SEQ ID NO: 947 - DNA, 108 bp, Artificial Sequence
  scaffold variant
tactggcgcttttatcttcattactttgagagccatcaccagcgactatgtcgtatgggtaaagcgcttatttgcggagagaaatccgataaataagaagcatcaaag

SEQ ID NO: 948 - DNA, 107 bp, Artificial Sequence; identical to SEQ ID NO: 552
  scaffold variant

SEQ ID NO: 949 - DNA, 108 bp, Artificial Sequence
  scaffold variant
gctggcgcttttatctcattactttgagagccatcaccagcgactatgtcgtatgggtaaagcgcttatttattcggagagaaatccgataaataagaagcatcaaag

SEQ ID NO: 950 - DNA, 108 bp, Artificial Sequence
  scaffold variant
tactggcgcttttatcatcattactttgagagccatcaccagcgactatgtcgtatgggtaaagcgcttatttatcgagagaaatccgataaataagaagcatcaaag

SEQ ID NO: 951 - DNA, 107 bp, Artificial Sequence
  scaffold variant
ctggcgcttttatctcattactttgagagccatcaccagcgactatgtcgtatgggtaaagcgcttatttatcggagagaaatccgcataaataagaagcatcaaag

SEQ ID NO: 952 - DNA, 110 bp, Artificial Sequence
  scaffold variant
tactggcgcttttatctcgattactttgagagccatcaccagcgactatgtcgtatgggtaaagcgcttatttatacggagagaaatccgataaataagaagcatcaaag

SEQ ID NO: 953 - DNA, 106 bp, Artificial Sequence
  scaffold variant
tctggcgcttttatctcattactttgagagccatcaccagcgactatgtcgtatgggtaaagcgcttatttatcggagtaaatccgataaataagaagcatcaaag

SEQ ID NO: 954 - DNA, 105 bp, Artificial Sequence
  scaffold variant
ctggcgcttttatctcattactttgagagccatcaccagcgactatgtcgtatgggtaaagcgcttatttatggagagaaatccgataaataagaagcatcaaag

SEQ ID NO: 955 - DNA, 109 bp, Artificial Sequence
  scaffold variant
tactggcgcttttatctcattactttgagagccatcaccagcgactatgtcgtatgggtaaagcgcttatttatctggagagaaatccgataaataagaagcatcaaag

SEQ ID NO: 956 - DNA, 108 bp, Artificial Sequence
  scaffold variant
actggcgcttttatctcattactttagagagccatcaccagcgactatgtcgtatgggtaaagcgcttatttatcggagagaaatccgataaataagaagcatcaaag

SEQ ID NO: 957 - DNA, 109 bp, Artificial Sequence
  scaffold variant
tactggcgcttttatctcattactttgagagccatcaccagcgactatgtcgtatgggtaaagcgcttatttattcggagagaaatccgataaataagaagcatcaaag

SEQ ID NO: 958 - DNA, 106 bp, Artificial Sequence
  scaffold variant
tacggcgcttttatctcattactttgagagccatcaccagcgactatgtcgtatgggtaaagctttatttatcggagagaaatccgataaataagaagcatcaaag

SEQ ID NO: 959 - DNA, 106 bp, Artificial Sequence
  scaffold variant
tctggcgcttttatctcattactttgagagccatcaccagcgactatgtcgtatgggtaaagcgcttatttatggagagaaatccgataaataagaagcatcaaag

SEQ ID NO: 960 - DNA, 107 bp, Artificial Sequence
  scaffold variant
tactggcgcttttatctcattactttgagagccatcaccagcgactatgtcgtatgggtaaagcgcttatttatccagagaaatccgataaataagaagcatcaaag

SEQ ID NO: 961 - DNA, 108 bp, Artificial Sequence
  scaffold variant
actggcgcttttatctctattactttgagagccatcaccagcgactatgtcgtatgggtaaagcgcttatttatcggagagaaatccgataaataagaagcatcaaag

SEQ ID NO: 962 - DNA, 106 bp, Artificial Sequence
  scaffold variant
gctggcgcttttatctcattactttgagagccatcaccagcgactatgtcgtatgggtaaagcgcttatttatcggagagaaatccctaaataagaagcatcaaag

SEQ ID NO: 963 - DNA, 108 bp, Artificial Sequence
  scaffold variant
tactggcgcttttatctcgattactttgagagccatcaccagcgactatgtcgtatgggtaaagcgcttatttatcaagagaaatccgataaataagaagcatcaaag

SEQ ID NO: 964 - DNA, 108 bp, Artificial Sequence
  scaffold variant
gctggcgcttttatcttcattactttgagagccatcaccagcgactatgtcgtatgggtaaagcgcttatttatcggagagaaatccgataaataagaagcatcaaag

SEQ ID NO: 965 - DNA, 106 bp, Artificial Sequence
  scaffold variant
actggcgcttttatctcattactttgagagccatcaccagcgactatgtcgtatgggtaaagcgcttatttatcggcagaaatccgataaataagaagcatcaaag

SEQ ID NO: 966 - DNA, 107 bp, Artificial Sequence
  scaffold variant
ctggcgcttttatctcattactttgagagccatcaccagcgactatgtcgtatgggtaaagcgcttatttatcggagagaaatccgataaataagagagcatcaaag

SEQ ID NO: 967 - DNA, 110 bp, Artificial Sequence
  scaffold variant
tactggcgcttttatctcattactttcgagagccatcaccagcgactatgtcgtatgggtaaagcgcttattttatcggagagaaatccgataaataagaagcatcaaag

SEQ ID NO: 968 - DNA, 106 bp, Artificial Sequence
  scaffold variant
tacggcgcttttatctcattactttgagagccatcaccagcgactatgtcgtatgggtaaagcgcttatttatggagagaaatccgataaataagaagcatcaaag

SEQ ID NO: 969 - DNA, 106 bp, Artificial Sequence
  scaffold variant
cctggcgcttttatctcattactttgagagccatcaccagcgactatgtcgtatgggtaaagcgcttatttatcggagagaaatggataaataagaagcatcaaag

SEQ ID NO: 970 - DNA, 107 bp, Artificial Sequence
  scaffold variant
ctggcgcttttatctcattactttgagagccatcaccagcgactatgtcgtatgggtaaagcgcttatttattcggagagaaatccgataaataagaagcatcaaag

SEQ ID NO: 971 - DNA, 110 bp, Artificial Sequence
  scaffold variant
tactggcgcttttatctgcattactttgagagccatcaccagcgactatgtcgtatgggtaaagcgcttatttatcggcagagaaatccgataaataagaagcatcaaag

SEQ ID NO: 972 - DNA, 108 bp, Artificial Sequence
  scaffold variant
tacggcgcttttatctcattactttgagagccatcaccagcgactatgtcgtatgggtaaagcgcttatttattcggagagaaatccgataaataagaagcatcaaag

SEQ ID NO: 973 - DNA, 107 bp, Artificial Sequence
  scaffold variant
tacggcgcttttatctcattactttgagagccatcaccagcgactatgtcgtatgggtaaagcgcttatttatcggggagaaatccgataaataagaagcatcaaag

SEQ ID NO: 974 - DNA, 106 bp, Artificial Sequence
  scaffold variant
tctggcgcttttatctcattactttgagagccatcaccagcgactatgtcgtatgggtaaagcgcttatttatcgcgagaaatccgataaataagaagcatcaaag

SEQ ID NO: 975 - DNA, 106 bp, Artificial Sequence
  scaffold variant
cctggcgcttttatctcattactttgagagccatcaccagcgactatgtcgtatgggtaaagcgcttatttatcggagagaaatccgaaaataagaagcatcaaag

SEQ ID NO: 976 - DNA, 108 bp, Artificial Sequence
  scaffold variant
tactggcgcttttatctcattactttcgagagccatcaccagcgactatgtcgtatgggtaaagcgcttatttatcggagagaaatccataaataagaagcatcaaag

SEQ ID NO: 977 - DNA, 106 bp, Artificial Sequence
  scaffold variant
tacggcgcttttatctcattactttgagagccatcaccagcgactatgtcgtatgggtaaagcgcttatttatcggagagtatccgataaataagaagcatcaaag

SEQ ID NO: 978 - DNA, 106 bp, Artificial Sequence
  scaffold variant
gctggcgcttttatctcattactttgagagccatcaccagcgactatgtcgtatgggtaaagcgcttatttccggagagaaatccgataaataagaagcatcaaag

SEQ ID NO: 979 - DNA, 106 bp, Artificial Sequence
  scaffold variant
tacggcgcttttatctcattactttgagagccatcaccagcgactatgtcgtatgggtaaagcgcttatttatcggaggaaatccgataaataagaagcatcaaag

SEQ ID NO: 980 - DNA, 105 bp, Artificial Sequence
  scaffold variant
actggcgcttttatctcattactttgagagccatcaccagcgactatgtcgtatgggtaaagcgcttatttatcggggaaatccgataaataagaagcatcaaag

SEQ ID NO: 981 - DNA, 110 bp, Artificial Sequence
  scaffold variant
tactggcgcttttatcctcattactttgagagccatcaccagcgactatgtcgtatgggtaaagcgcttatttactcggagagaaatccgataaataagaagcatcaaag

SEQ ID NO: 982 - DNA, 105 bp, Artificial Sequence
  scaffold variant
cctggcgcttttatctcattactttgagagccatcaccagcgactatgtcgtatgggtaaagcgcttatttatcggagagacccgataaataagaagcatcaaag

SEQ ID NO: 983 - DNA, 110 bp, Artificial Sequence
  scaffold variant
tactggcgcttttatctcattactttcgagagccatcaccagcgactatgtcgtatgggtaaagcgcttatttatctggagagaaatccgataaataagaagcatcaaag

SEQ ID NO: 984 - DNA, 106 bp, Artificial Sequence
  scaffold variant
gctggcgcttttatctcattactttgagagccatcaccagcgactatgtcgtatgggtaaagcgcttatttatcggagagaaaacgataaataagaagcatcaaag

SEQ ID NO: 985 - DNA, 109 bp, Artificial Sequence; identical to SEQ ID NO: 785
  scaffold variant

SEQ ID NO: 986 - DNA, 109 bp, Artificial Sequence
  scaffold variant
tactggcgcttttatctcattactttgagagccatcaccagcgactatgtcgtatgggtaaagcgcttatttatcggagagaaatcacgataaataagaagcatcaaag

SEQ ID NO: 987 - DNA, 110 bp, Artificial Sequence
  scaffold variant
ctactggcgcttttatctcattactttgagagccatcaccagcgactatgtcgtatgggtaaagcgcttatttatcggcagagaaatccgataaataagaagcatcaaag

SEQ ID NO: 988 - DNA, 108 bp, Artificial Sequence
  scaffold variant
cctggcgcttttatctcattactttgagagccatcaccagcgactatgtcgtatgggtaaagcgcttatttaatcggagagaaatccgataaataagaagcatcaaag

SEQ ID NO: 989 - DNA, 108 bp, Artificial Sequence
  scaffold variant
tactggcgcttttaatctcattactttgagagccatcaccagcgactatgtcgtatgggtaaagcgcttatttatcggagagaaatccataaataagaagcatcaaag

SEQ ID NO: 990 - DNA, 110 bp, Artificial Sequence
  scaffold variant
tactggcgcttttattctcattactttgagagccatcaccagcgactatgtcgtattgggtaaagcgcttatttatcggagagaaatccgataaataagaagcatcaaag

SEQ ID NO: 991 - DNA, 104 bp, Artificial Sequence
  scaffold variant
tggcgcttttatctcattactttgagagccatcaccagcgactatgtcgtatgggtaaagcgcttatttatccagagaaatccgataaataagaagcatcaaag

SEQ ID NO: 992 - DNA, 109 bp, Artificial Sequence
  scaffold variant
tactggcgcttttatctcattactttgagagccatcaccagcgactatgtcgtatgggtaaagcgcttatttactcggagagaaatccgataaataagaagcatcaaag

SEQ ID NO: 993 - DNA, 109 bp, Artificial Sequence
  scaffold variant
tactggcgcttttatctcattactttgagagccatcaccagcgactatgtcgtattgggtaaagcgcttatttatcggagagaaatccgataaataagaagcatcaaag

SEQ ID NO: 994 - DNA, 108 bp, Artificial Sequence
  scaffold variant
actggcgcttttatctcattactttgcagagccatcaccagcgactatgtcgtatgggtaaagcgcttatttatcggagagaaatccgataaataagaagcatcaaag

SEQ ID NO: 995 - DNA, 105 bp, Artificial Sequence
  scaffold variant
ctggcgcttttatctcattactttgagagccatcaccagcgactatgtcgtatgggtaaagcgcttatttatcggagagaaatccgaaaataagaagcatcaaag

SEQ ID NO: 996 - DNA, 110 bp, Artificial Sequence
  scaffold variant
tactggcgcttttatctcattactttgagagccatcaccagcgactatgtcgtagtgggtaaagcgcttatttatcggagagaaatcgcgataaataagaagcatcaaag

SEQ ID NO: 997 - DNA, 108 bp, Artificial Sequence
  scaffold variant
tacggcgcttttatctcattactttgagagccatcaccagcgactatgtcgtatgggtaaagcgcttatttatcggtagagaaatccgataaataagaagcatcaaag

SEQ ID NO: 998 - DNA, 108 bp, Artificial Sequence
  scaffold variant
tactggcgcttttatctcattactttgagagccatcaccagcgactatgtcgtatgggtaaagcgcttatttatcggagagaaatccggtaaataagaagcatcaaag

SEQ ID NO: 999 - DNA, 106 bp, Artificial Sequence
  scaffold variant
actggcgcttttatctcattactttgagagccatcaccagcgactatgtcgtatgggtaaagcgcttatttatcggagagaaaacgataaataagaagcatcaaag

SEQ ID NO: 1000 - DNA, 105 bp, Artificial Sequence; identical to SEQ ID NO: 590
  scaffold variant

SEQ ID NO: 1001 - DNA, 110 bp, Artificial Sequence
  scaffold variant
tactggcgcttttatctgcattactttgagagccatcaccagcgactatgtcgtatgggtaaagcgcttatttattcggagagaaatccgataaataagaagcatcaaag

SEQ ID NO: 1002 - DNA, 108 bp, Artificial Sequence
  scaffold variant
tacggcgcttttatctcattactttgagagccatcaccagcgactatgtcgtatgggtaaagcgcttattatatcggagagaaatccgataaataagaagcatcaaag

SEQ ID NO: 1003 - DNA, 107 bp, Artificial Sequence
  scaffold variant
atggcgcttttatctcattactttgagagccatcaccagcgactatgtcgtatgggtaaagcgcttatttatccggagagaaatccgataaataagaagcatcaaag

SEQ ID NO: 1004 - DNA, 105 bp, Artificial Sequence
  scaffold variant
ctggcgcttttatctcattactttgagagccatcaccagcgactatgtcgtatgggtaaagcgcttatttgcggagagaaatccgataaataagaagcatcaaag

SEQ ID NO: 1005 - DNA, 108 bp, Artificial Sequence
  scaffold variant
ttactggcgcttttatctcattactttgagagccatcaccagcgactatgtcgtatgggtaaagcgcttattttcggagagaaatccgataaataagaagcatcaaag

SEQ ID NO: 1006 - DNA, 106 bp, Artificial Sequence; identical to SEQ ID NO: 554
  scaffold variant

SEQ ID NO: 1007 - DNA, 108 bp, Artificial Sequence
  scaffold variant
tactggcgcttttatctcattactttgagagccatcaccagcgactatgtcgtagtgggtaaagcgcttatttatcggagagaaatcgataaataagaagcatcaaag

SEQ ID NO: 1008 - DNA, 110 bp, Artificial Sequence
  scaffold variant
tactggcgcttttatctctattactttgagagccatcaccagcgactatgtcgtatgggtaaagcgcttatttactcggagagaaatccgataaataagaagcatcaaag

SEQ ID NO: 1009 - DNA, 105 bp, Artificial Sequence
  scaffold variant
cctggcgcttttatctcattactttgagagccatcaccagcgactatgtcgtatgggtaaagcgcttatttatcggagatatccgataaataagaagcatcaaag

SEQ ID NO: 1010 - DNA, 108 bp, Artificial Sequence
  scaffold variant
tctggcgcttttatctcattactttgagagccatcaccagcgactatgtcgtatgggtaaagcgcttattgtatcggagagaaatccgataaataagaagcatcaaag

SEQ ID NO: 1011 - DNA, 105 bp, Artificial Sequence
  scaffold variant
cctggcgcttttatctcattactttgagagccatcaccagcgactatgtcgtatgggtaaagcgcttatttatcggcgaaatccgataaataagaagcatcaaag

SEQ ID NO: 1012 - DNA, 107 bp, Artificial Sequence
  scaffold variant
actggcgcttttatctcattactttgagagccatcaccagcgactatgtcgtatgggtaaagcgcttatttatcggcgagaaatccgataaataagaagcatcaaag

SEQ ID NO: 1013 - DNA, 108 bp, Artificial Sequence
  scaffold variant
tactggcgcttttatctcgattactttgagagccatcaccagcgactatgtcgtatgggtaaagcgcttatttatcggagataatccgataaataagaagcatcaaag

SEQ ID NO: 1014 - DNA, 106 bp, Artificial Sequence
  scaffold variant
tacggcgcttttatctcattactttgagagccatcaccagcgactatgtcgtatgggtaaagcgcttatttatcggagagaaaacgataaataagaagcatcaaag

SEQ ID NO: 1015 - DNA, 110 bp, Artificial Sequence
  scaffold variant
tactggcgcttttatcatcattactttgagagccatcaccagcgactatgtcgtatgggtaaagcgcttatttatccggagagaaatccgataaataagaagcatcaaag

SEQ ID NO: 1016 - DNA, 108 bp, Artificial Sequence
  scaffold variant
tactggcgcttttatctcattactttgagagccatcaccagcgactatgtcgtatgggtaaagcgcttatttatcggagagaaatcagataaataagaagcatcaaag

SEQ ID NO: 1017 - DNA, 107 bp, Artificial Sequence
  scaffold variant
tactggcgcttttatctcattactttgagagccatcaccagcgactatgtcgtatgggtaaagcgcttatttatcgggagaaatccgataaataagaagcatcaaag

SEQ ID NO: 1018 - DNA, 107 bp, Artificial Sequence; identical to SEQ ID NO: 878
  scaffold variant

SEQ ID NO: 1019 - DNA, 108 bp, Artificial Sequence
  scaffold variant
tactggcgcttttattctcattactttgagagccatcaccagcgactatgtcgtatgggtaaagcgcttatttatcggaggaaatccgataaataagaagcatcaaag

SEQ ID NO: 1020 - DNA, 107 bp, Artificial Sequence
  scaffold variant
cctggcgcttttatctcattactttgagagccatcaccagcgactatgtcgtatgggtaaagcgcttatttatcggagagaaattcgataaataagaagcatcaaag

SEQ ID NO: 1021 - DNA, 107 bp, Artificial Sequence; identical to SEQ ID NO: 878
  scaffold variant

SEQ ID NO: 1022 - DNA, 108 bp, Artificial Sequence
  scaffold variant
tctggcgcttttatcctcattactttgagagccatcaccagcgactatgtcgtatgggtaaagcgcttatttatcggagagaaatccgataaataagaagcatcaaag

SEQ ID NO: 1023 - DNA, 106 bp, Artificial Sequence
  scaffold variant
tacggcgcttttatctcattactttgagagccatcaccagcgactatgtcgtatgggtaaagcgcttatttatcggagagcatccgataaataagaagcatcaaag

SEQ ID NO: 1024 - DNA, 110 bp, Artificial Sequence
  scaffold variant
tactggcgcttttattctcattactttgagagccatcaccagcgactatgtcgtatgggtaaagcgcttatttatcggagagaaatcctgataaataagaagcatcaaag

SEQ ID NO: 1025 - DNA, 109 bp, Artificial Sequence
  scaffold variant
tactggcgcttttatctcattactttgagagccatcaccagcgactatgtcgtatgggtaaagcgcttatttatccggagagaaatccgataaataagaagcatcaaag

SEQ ID NO: 1026 - DNA, 106 bp, Artificial Sequence
  scaffold variant
cctggcgcttttatctcattactttgagagccatcaccagcgactatgtcgtatgggtaaagcgcttatttatcggagagaagccgataaataagaagcatcaaag

SEQ ID NO: 1027 - DNA, 104 bp, Artificial Sequence; identical to SEQ ID NO: 766
  scaffold variant

SEQ ID NO: 1028 - DNA, 108 bp, Artificial Sequence
  scaffold variant
tctggcgcttttatctcattactttgagagccatcaccagcgactatgtcgtatgggtaaagcgcttatttatcggagagaaatccgcataaataagaagcatcaaag

SEQ ID NO: 1029 - DNA, 108 bp, Artificial Sequence
  scaffold variant
cctggcgcttttatctcgattactttgagagccatcaccagcgactatgtcgtatgggtaaagcgcttatttatcggagagaaatccgataaataagaagcatcaaag

SEQ ID NO: 1030 - DNA, 107 bp, Artificial Sequence; identical to SEQ ID NO: 878
  scaffold variant

SEQ ID NO: 1031 - DNA, 108 bp, Artificial Sequence
  scaffold variant
cctggcgcttttatctcattactttgagagccatcaccagcgactatgtcgtatgggtaaagcgcttatttatcggagaggaaatccgataaataagaagcatcaaag

SEQ ID NO: 1032 - DNA, 109 bp, Artificial Sequence; identical to SEQ ID NO: 785
  scaffold variant

SEQ ID NO: 1033 - DNA, 106 bp, Artificial Sequence
  scaffold variant
tggcgcttttatctcattactttgagagccatcaccagcgactatgtcgtatgggtaaagcgcttatttatcggagagaaatcccgataaataagaagcatcaaag

SEQ ID NO: 1034 - DNA, 104 bp, Artificial Sequence
  scaffold variant
tggcgcttttatctcattactttgagagccatcaccagcgactatgtcgtatgggtaaagcgcttatttatggagagaaatccgataaataagaagcatcaaag

SEQ ID NO: 1035 - DNA, 107 bp, Artificial Sequence
  scaffold variant
tactggcgcttttatctcattactttgagagccatcaccagcgactatgtcgtatgggtaaagcgcttatttatcaagagaaatccgataaataagaagcatcaaag

SEQ ID NO: 1036 - DNA, 110 bp, Artificial Sequence
  scaffold variant
tactggcgcttttatctcattactttgagagccatcaccagcgactatgtcgtatgggtaaagcgcttatttatacggagagaaatcccgataaataagaagcatcaaag

SEQ ID NO: 1037 - DNA, 110 bp, Artificial Sequence
  scaffold variant
tactggcgcttttatctgcattactttgagagccatcaccagcgactatgtcgtatgggtaaagcgcttattatatcggagagaaatccgataaataagaagcatcaaag

SEQ ID NO: 1038 - DNA, 106 bp, Artificial Sequence
  scaffold variant
tacggcgcttttatctcattactttgagagccatcaccagcgactatgtcgtatgggtaaagcgcttatttatcggagacaatccgataaataagaagcatcaaag

SEQ ID NO: 1039 - DNA, 108 bp, Artificial Sequence
  scaffold variant
tactggcgcttttatctcattactttgagagccatcaccagcgactatgtcgtatgggtaaagcgcttatttatccggagagaaatccataaataagaagcatcaaag

SEQ ID NO: 1040 - DNA, 108 bp, Artificial Sequence
  scaffold variant
tacggcgcttttatctcattactttgagagccatcaccagcgactatgtcgtatgggtaaagcgcttattttatcggagagaaatccgataaataagaagcatcaaag

SEQ ID NO: 1041 - DNA, 110 bp, Artificial Sequence
  scaffold variant
tactggcgcttttatctcattactttagagagccatcaccagcgactatgtcgtatgggtaaagcgcttatttatcaggagagaaatccgataaataagaagcatcaaag

SEQ ID NO: 1042 - DNA, 108 bp, Artificial Sequence
  scaffold variant
tactggcgcttttatcgtcattactttgagagccatcaccagcgactatgtcgtatgggtaaagcgcttatttatctagagaaatccgataaataagaagcatcaaag

SEQ ID NO: 1043 - DNA, 105 bp, Artificial Sequence
  scaffold variant
ctggcgcttttatctcattactttgagagccatcaccagcgactatgtcgtatgggtaaagcgcttatttatcggagagtatccgataaataagaagcatcaaag

SEQ ID NO: 1044 - DNA, 110 bp, Artificial Sequence
  scaffold variant
tactggcgcttttatcttcattactttgagagccatcaccagcgactatgtcgtatgggtaaagcgcttatcttatcggagagaaatccgataaataagaagcatcaaag

SEQ ID NO: 1045 - DNA, 109 bp, Artificial Sequence
  scaffold variant
tactggcgcttttatctcattactttgagagccatcaccagcgactatgtcgtatgggtaaagcgcttatttatgaggagagaaatccgataaataagaagcatcaaag

SEQ ID NO: 1046 - DNA, 106 bp, Artificial Sequence
  scaffold variant
tggcgcttttatctcattactttgagagccatcaccagcgactatgtcgtatgggtaaagcgcttatttattcggagagaaatccgataaataagaagcatcaaag

SEQ ID NO: 1047 - DNA, 105 bp, Artificial Sequence
  scaffold variant
cctggcgcttttatctcattactttgagagccatcaccagcgactatgtcgtatgggtaaagcgcttatttatcggggaaatccgataaataagaagcatcaaag

SEQ ID NO: 1048 - DNA, 110 bp, Artificial Sequence
  scaffold variant
ttactggcgcttttatctcattactttcgagagccatcaccagcgactatgtcgtatgggtaaagcgcttatttatcggagagaaatccgataaataagaagcatcaaag

SEQ ID NO: 1049 - DNA, 109 bp, Artificial Sequence
  scaffold variant
tactggcgcttttatctcattactttgagagccatcaccagcgactatgtcgtatgggtaaagcgcttatttatcggagagaaatccgcataaataagaagcatcaaag

SEQ ID NO: 1050 - DNA, 107 bp, Artificial Sequence
  scaffold variant
ctggcgcttttatctcattactttgagagccatcaccagcgactatgtcgtatgggtaaagcgcttatttactcggagagaaatccgataaataagaagcatcaaag

SEQ ID NO: 1051 - DNA, 108 bp, Artificial Sequence
  scaffold variant
tactggcgcttttatctctattactttgagagccatcaccagcgactatgtcgtatgggtaaagcgcttatttatcgagagaaatccgataaataagaagcatcaaag

SEQ ID NO: 1052 - DNA, 106 bp, Artificial Sequence
  scaffold variant
tacggcgcttttatctcattactttgagagccatcaccagcgactatgtcgtatgggtaaagcgcttatttatcggagagaaatagataaataagaagcatcaaag

SEQ ID NO: 1053 - DNA, 105 bp, Artificial Sequence; identical to SEQ ID NO: 1043
  scaffold variant

SEQ ID NO: 1054 - DNA, 107 bp, Artificial Sequence
  scaffold variant
cctggcgcttttatctcattactttgagagccatcaccagcgactatgtcgtatgggtaaagcgcttatttatcgtagagaaatccgataaataagaagcatcaaag

SEQ ID NO: 1055 - DNA, 109 bp, Artificial Sequence
  scaffold variant
tactggcgcttttatctcattactttgagagccatcaccagcgactatgtcgtatgggtaaagcgcttatttatacggagagaaatccgataaataagaagcatcaaag

SEQ ID NO: 1056 - DNA, 108 bp, Artificial Sequence
  scaffold variant
tacggcgcttttatctcattactttgagagccatcaccagcgactatgtcgtatgggtaaagcgcttatttatcgcgagagaaatccgataaataagaagcatcaaag

SEQ ID NO: 1057 - DNA, 107 bp, Artificial Sequence
  scaffold variant
ctggcgcttttatctcattactttgagagccatcaccagcgactatgtcgtatgggtaaagcgcttatttatcggtagagaaatccgataaataagaagcatcaaag

SEQ ID NO: 1058 - DNA, 106 bp, Artificial Sequence
  scaffold variant
actggcgcttttatctcattactttgagagccatcaccagcgactatgtcgtatgggtaaagcgcttattttcggagagaaatccgataaataagaagcatcaaag

SEQ ID NO: 1059 - DNA, 105 bp, Artificial Sequence
  scaffold variant
actggcgcttttatctcattactttgagagccatcaccagcgactatgtcgtatgggtaaagcgcttatttatcagagaaatccgataaataagaagcatcaaag

SEQ ID NO: 1060 - DNA, 107 bp, Artificial Sequence
  scaffold variant
atggcgcttttatctcattactttgagagccatcaccagcgactatgtcgtatgggtaaagcgcttatttattcggagagaaatccgataaataagaagcatcaaag

SEQ ID NO: 1061 - DNA, 108 bp, Artificial Sequence
  scaffold variant
tactggcgcttttatctcattactttgagagccatcaccagcgactatgtcgtatgggtaaagcgcttatttatgcggagagaaatcgataaataagaagcatcaaag

SEQ ID NO: 1062 - DNA, 109 bp, Artificial Sequence
  scaffold variant
tactggcgcttttatctcattactttgagagccatcaccagcgactatgtcgtatgggtaaagcgcttatttatcggagagaaatcctgataaataagaagcatcaaag

SEQ ID NO: 1063 - DNA, 108 bp, Artificial Sequence
  scaffold variant
ctactggcgcttttatctcattactttgagagccatcaccagcgactatgtcgtatgggtaaagcgcttatttatcgggagaaatccgataaataagaagcatcaaag

SEQ ID NO: 1064 - DNA, 108 bp, Artificial Sequence
  scaffold variant
tactggcgcttttatctattactttgagagccatcaccagcgactatgtcgtatgggtaaagcgcttatttatacggagagaaatccgataaataagaagcatcaaag

SEQ ID NO: 1065 - DNA, 107 bp, Artificial Sequence; identical to SEQ ID NO: 878
  scaffold variant

SEQ ID NO: 1066 - DNA, 107 bp, Artificial Sequence
  scaffold variant
tacggcgcttttatctcattactttgagagccatcaccagcgactatgtcgtatgggtaaagcgcttatttatcggcgagaaatccgataaataagaagcatcaaag

SEQ ID NO: 1067 - DNA, 109 bp, Artificial Sequence; identical to SEQ ID NO: 785
  scaffold variant

SEQ ID NO: 1068 - DNA, 106 bp, Artificial Sequence
  scaffold variant
gctggcgcttttatctcattactttgagagccatcaccagcgactatgtcgtatgggtaaagcgcttatttattgagagaaatccgataaataagaagcatcaaag

SEQ ID NO: 1069 - DNA, 109 bp, Artificial Sequence; identical to SEQ ID NO: 785
  scaffold variant

SEQ ID NO: 1070 - DNA, 110 bp, Artificial Sequence
  scaffold variant
tactggcgcttttatcttcattactttgagagccatcaccagcgactatgtcgtatgggtaaagcgcttatttatcggagagacaatccgataaataagaagcatcaaag

SEQ ID NO: 1071 - DNA, 108 bp, Artificial Sequence
  scaffold variant
gctggcgcttttatcctcattactttgagagccatcaccagcgactatgtcgtatgggtaaagcgcttatttatcggagagaaatccgataaataagaagcatcaaag

SEQ ID NO: 1072 - DNA, 107 bp, Artificial Sequence; identical to SEQ ID NO: 520
  scaffold variant

SEQ ID NO: 1073 - DNA, 105 bp, Artificial Sequence
  scaffold variant
ctggcgcttttatctcattactttgagagccatcaccagcgactatgtcgtatgggtaaagcgcttatttatcggaggaaatccgataaataagaagcatcaaag

SEQ ID NO: 1074 - DNA, 107 bp, Artificial Sequence; identical to SEQ ID NO: 878
  scaffold variant

SEQ ID NO: 1075 - DNA, 105 bp, Artificial Sequence
  scaffold variant
atggcgcttttatctcattactttgagagccatcaccagcgactatgtcgtatgggtaaagcgcttatttatcggagataatccgataaataagaagcatcaaag

SEQ ID NO: 1076 - DNA, 108 bp, Artificial Sequence
  scaffold variant
tactggcgcttttatctcattactttgagagccatcaccagcgactatgtcgtatgggtaaagcgcttatttatcgagagaaatccgataaataagaaagcatcaaag

SEQ ID NO: 1077 - DNA, 106 bp, Artificial Sequence
  scaffold variant
gctggcgcttttatctcattactttgagagccatcaccagcgactatgtcgtatgggtaaagcgcttatttatcggagagaaatccgtaaataagaagcatcaaag

SEQ ID NO: 1078 - DNA, 109 bp, Artificial Sequence; identical to SEQ ID NO: 785
  scaffold variant

SEQ ID NO: 1079 - DNA, 106 bp, Artificial Sequence
  scaffold variant
tacggcgcttttatctcattactttgagagccatcaccagcgactatgtcgtatgggtaaagcgcttatttatcggtagaaatccgataaataagaagcatcaaag

SEQ ID NO: 1080 - DNA, 108 bp, Artificial Sequence
  scaffold variant
gctggcgcttttatctcattactttgagagccatcaccagcgactatgtcgtatgggtaaagcgcttatttatcggagagaaatccgataaataagagagcatcaaag

SEQ ID NO: 1081 - DNA, 107 bp, Artificial Sequence
  scaffold variant
tactggcgcttttatctcattactttgagagccatcaccagcgactatgtcgtatgggtaaagcgcttatttatctagagaaatccgataaataagaagcatcaaag

SEQ ID NO: 1082 - DNA, 108 bp, Artificial Sequence
  scaffold variant
gctggcgcttttatctcattactttgagagccatcaccagcgactatgtcgtatgggtaaagcgcttatttatacggagagaaatccgataaataagaagcatcaaag

SEQ ID NO: 1083 - DNA, 106 bp, Artificial Sequence
  scaffold variant
gctggcgcttttatctcattactttgagagccatcaccagcgactatgtcgtatgggtaaagcgcttatttatcaagagaaatccgataaataagaagcatcaaag

SEQ ID NO: 1084 - DNA, 107 bp, Artificial Sequence
  scaffold variant
ctggcgcttttatctcattactttgagagccatcaccagcgactatgtcgtatgggtaaagcgcttatttatcaggagagaaatccgataaataagaagcatcaaag

SEQ ID NO: 1085 - DNA, 106 bp, Artificial Sequence
  scaffold variant
cctggcgcttttatctcattactttgagagccatcaccagcgactatgtcgtatgggtaaagcgcttatttatcggagagaaatagataaataagaagcatcaaag

SEQ ID NO: 1086 - DNA, 109 bp, Artificial Sequence; identical to SEQ ID NO: 1025
  scaffold variant

SEQ ID NO: 1087 - DNA, 106 bp, Artificial Sequence
  scaffold variant
tctggcgcttttatctcattactttagagccatcaccagcgactatgtcgtatgggtaaagcgcttatttatcggagagaaatccgataaataagaagcatcaaag

SEQ ID NO: 1088 - DNA, 108 bp, Artificial Sequence
  scaffold variant
actggcgcttttatcctcattactttgagagccatcaccagcgactatgtcgtatgggtaaagcgcttatttatcggagagaaatccgataaataagaagcatcaaag

SEQ ID NO: 1089 - DNA, 108 bp, Artificial Sequence
  scaffold variant
atactggcgcttttatctcattactttgagagccatcaccagcgactatgtcgtatgggtaaagcgcttatttatcgagagaaatccgataaataagaagcatcaaag

SEQ ID NO: 1090 - DNA, 108 bp, Artificial Sequence
  scaffold variant
tactggcgcttttatctctattactttgagagccatcaccagcgactatgtcgtatgggtaaagcgcttatttatcgtgagaaatccgataaataagaagcatcaaag

SEQ ID NO: 1091 - DNA, 110 bp, Artificial Sequence
  scaffold variant
tactggcgcttttatcttcattactttgagagccatcaccagcgactatgtcgtatgggtaaagcgcttatttatcgagagagaaatccgataaataagaagcatcaaag

SEQ ID NO: 1092 - DNA, 108 bp, Artificial Sequence
  scaffold variant
tactggcgcttttattctcattactttgagagccatcaccagcgactatgtcgtatgggtaaagcgcttatttatcggagagaaatccgtaaataagaagcatcaaag

SEQ ID NO: 1093 - DNA, 109 bp, Artificial Sequence
  scaffold variant
tactggcgcttttatctcattactttgagagccatcaccagcgactatgtcgtatgggtaaagcgcttatttatcggagagaaatcccgataaataagaagcatcaaag

SEQ ID NO: 1094 - DNA, 108 bp, Artificial Sequence
  scaffold variant
tactggcgcttttatctcattactttgagagccatcaccagcgactatgtcgtatgggtaaagcgcttatttatccggagagaaatcgataaataagaagcatcaaag

SEQ ID NO: 1095 - DNA, 108 bp, Artificial Sequence
  scaffold variant
gctggcgcttttatctcattactttgagagccatcaccagcgactatgtcgtatgggtaaagcgcttatttatcggagagaaatcccgataaataagaagcatcaaag

SEQ ID NO: 1096 - DNA, 107 bp, Artificial Sequence; identical to SEQ ID NO: 528
  scaffold variant

SEQ ID NO: 1097 - DNA, 108 bp, Artificial Sequence
  scaffold variant
ttactggcgcttttatctcattactttgagagccatcaccagcgactatgtcgtatgggtaaagcgcttatttatcggagagaaatcgataaataagaagcatcaaag

SEQ ID NO: 1098 - DNA, 108 bp, Artificial Sequence
  scaffold variant
tactggcgcttttatcctcattactttgagagccatcaccagcgactatgtcgtatgggtaaagcgcttatttatcggaggaaatccgataaataagaagcatcaaag

SEQ ID NO: 1099 - DNA, 108 bp, Artificial Sequence
  scaffold variant
cctggcgcttttatctcattactttgagagccatcaccagcgactatgtcgtatgggtaaagcgcttattgtatcggagagaaatccgataaataagaagcatcaaag

SEQ ID NO: 1100 - DNA, 107 bp, Artificial Sequence
  scaffold variant
ctggcgcttttatctcattactttgagagccatcaccagcgactatgtcgtatgggtaaagcgcttatttatcggagagaaatgccgataaataagaagcatcaaag

SEQ ID NO: 1101 - DNA, 106 bp, Artificial Sequence
  scaffold variant
tctggcgcttttatctcattactttgagagccatcaccagcgactatgtcgtatgggtaaagcgcttatttatcggagagaaatccgatagtaagaagcatcaaag

SEQ ID NO: 1102 - DNA, 106 bp, Artificial Sequence; identical to SEQ ID NO: 504
  scaffold variant

SEQ ID NO: 1103 - DNA, 108 bp, Artificial Sequence
  scaffold variant
tactggcgcttttattctcattactttgagagccatcaccagcgactatgtcgtatgggtaaagcgcttatttatcggaagaaatccgataaataagaagcatcaaag

SEQ ID NO: 1104 - DNA, 105 bp, Artificial Sequence
  scaffold variant
ctggcgcttttatctcattactttgagagccatcaccagcgactatgtcgtatgggtaaagcgcttatttatcggagagagtccgataaataagaagcatcaaag

SEQ ID NO: 1105 - DNA, 107 bp, Artificial Sequence
  scaffold variant
atggcgcttttatctcattactttgagagccatcaccagcgactatgtcgtatgggtaaagcgcttatttatctggagagaaatccgataaataagaagcatcaaag

SEQ ID NO: 1106 - DNA, 108 bp, Artificial Sequence
  scaffold variant
actggcgcttttatctcattactttgagagccatcaccagcgactatgtcgtatgggtaaagcgcttatttatcggagagataatccgataaataagaagcatcaaag

SEQ ID NO: 1107 - DNA, 110 bp, Artificial Sequence
  scaffold variant
tactggcgcttttatctcgattactttgagagccatcaccagcgactatgtcgtatgggtaaagcgcttatttatcggagagaaatcgcgataaataagaagcatcaaag

SEQ ID NO: 1108 - DNA, 106 bp, Artificial Sequence
  scaffold variant
cctggcgcttttatctcattactttgagagccatcaccagcgactatgtcgtatgggtaaagcattatttatcggagagaaatccgataaataagaagcatcaaag

SEQ ID NO: 1109 - DNA, 110 bp, Artificial Sequence
  scaffold variant
tactggcgcttttatctcattactttgagagccatcaccagcgactatgtcgtatgggtaaagcgcttatttatgcggagagaaatcacgataaataagaagcatcaaag

SEQ ID NO: 1110 - DNA, 107 bp, Artificial Sequence; identical to SEQ ID NO: 520
  scaffold variant

SEQ ID NO: 1111 - DNA, 107 bp, Artificial Sequence
  scaffold variant
ctggcgcttttatctcattactttgagagccatcaccagcgactatgtcgtattgggtaaagcgcttatttatcggagagaaatccgataaataagaagcatcaaag

SEQ ID NO: 1112 - DNA, 108 bp, Artificial Sequence
  scaffold variant
tactggcgcttttatctcattactttgagagccatcaccagcgactatgtcgtagtgggtaaagcgcttatttatcgggagaaatccgataaataagaagcatcaaag

SEQ ID NO: 1113 - DNA, 110 bp, Artificial Sequence
  scaffold variant
ttactggcgcttttatctcattactttgagagccatcaccagcgactatgtcgtagtgggtaaagcgcttatttatcggagagaaatccgataaataagaagcatcaaag

SEQ ID NO: 1114 - DNA, 108 bp, Artificial Sequence
  scaffold variant
tacggcgcttttatctcattactttgagagccatcaccagcgactatgtcgtatgggtaaagcgcttatttatcaggagagaaatccgataaataagaagcatcaaag

SEQ ID NO: 1115 - DNA, 108 bp, Artificial Sequence
  scaffold variant
tactggcgcttttatctgcattactttgagagccatcaccagcgactatgtcgtatgggtaaagcgcttatttatcggagagaaatccataaataagaagcatcaaag

SEQ ID NO: 1116 - DNA, 107 bp, Artificial Sequence
  scaffold variant
cctggcgcttttatctcattactttgagagccatcaccagcgactatgtcgtatgggtaaagcgcttatttatcggagagcaatccgataaataagaagcatcaaag

SEQ ID NO: 1117 - DNA, 108 bp, Artificial Sequence
  scaffold variant
tactggcgcttttatctcattactttgagagccatcaccagcgactatgtcgtatgggtaaagcgcttatttatcggagagaaatccgatgaataagaagcatcaaag

SEQ ID NO: 1118 - DNA, 108 bp, Artificial Sequence
  scaffold variant
tactggcgcttttatcttcattactttgagagccatcaccagcgactatgtcgtatgggtaaagcgcttatttatcggagagaaagcgataaataagaagcatcaaag

SEQ ID NO: 1119 - DNA, 110 bp, Artificial Sequence
  scaffold variant
tactggcgcttttatctcgattactttgagagccatcaccagcgactatgtcgtatgggtaaagcgcttatttatcgagagagaaatccgataaataagaagcatcaaag

SEQ ID NO: 1120 - DNA, 110 bp, Artificial Sequence
  scaffold variant
tactggcgcttttatctcattactttgagagccatcaccagcgactatgtcgtattgggtaaagcgcttatttatgcggagagaaatccgataaataagaagcatcaaag

SEQ ID NO: 1121 - DNA, 106 bp, Artificial Sequence
  scaffold variant
cctggcgcttttatctcattactttgagagccatcaccagcgactatgtcgtatgggtaaagcgcttatttatcggagaggatccgataaataagaagcatcaaag

SEQ ID NO: 1122 - DNA, 108 bp, Artificial Sequence
  scaffold variant
tactggcgcttttatctgcattactttgagagccatcaccagcgactatgtcgtatgggtaaagcgcttatttatggagagaaatccgataaataagaagcatcaaag

SEQ ID NO: 1123 - DNA, 106 bp, Artificial Sequence
  scaffold variant
tctggcgcttttatctcattactttgagagccatcaccagcgactatgtcgtatgggtaaagcgcttatttatcggagagaaaacgataaataagaagcatcaaag

SEQ ID NO: 1124 - DNA, 106 bp, Artificial Sequence
  scaffold variant
tactggcgcttttatctcattactttgagagccatcaccagcgactatgtcgtatgggtaaagcggtatttatcgagagaaatccgataaataagaagcatcaaag

SEQ ID NO: 1125 - DNA, 107 bp, Artificial Sequence
  scaffold variant
atggcgcttttatctcattactttgagagccatcaccagcgactatgtcgtatgggtaaagcgcttatttatcggagagaaatcacgataaataagaagcatcaaag

SEQ ID NO: 1126 - DNA, 108 bp, Artificial Sequence
  scaffold variant
tactggcgcttttatctcattactttgagagccatcaccagcgactatgtcgtatgggtaaagcgtttatttatcggagagaaatccgataaataagaagcatcaaag

SEQ ID NO: 1127 - DNA, 108 bp, Artificial Sequence
  scaffold variant
tactggcgcttttatcgtcattactttgagagccatcaccagcgactatgtcgtatgggtaaagcgcttatttatcgagagaaatccgataaataagaagcatcaaag

SEQ ID NO: 1128 - DNA, 108 bp, Artificial Sequence
  scaffold variant
actggcgcttttatctcattactttgagagccatcaccagcgactatgtcgtatgggtaaagcgcttatttatcggagagaaatcctgataaataagaagcatcaaag

SEQ ID NO: 1129 - DNA, 107 bp, Artificial Sequence
  scaffold variant
cctggcgcttttatctcattactttgagagccatcaccagcgactatgtcgtatgggtaaagcgcttatttatcggatttctctccgataaataagaagcatcaaag

SEQ ID NO: 1130 - DNA, 105 bp, Artificial Sequence; identical to SEQ ID NO: 590
  scaffold variant

SEQ ID NO: 1131 - DNA, 107 bp, Artificial Sequence; identical to SEQ ID NO: 960
  scaffold variant

SEQ ID NO: 1132 - DNA, 110 bp, Artificial Sequence
  scaffold variant
tactggcgcttttatctgcattactttgagagccatcaccagcgactatgtcgtatgggtaaagcgcttattctatcggagagaaatccgataaataagaagcatcaaag

SEQ ID NO: 1133 - DNA, 107 bp, Artificial Sequence; identical to SEQ ID NO: 960
  scaffold variant

SEQ ID NO: 1134 - DNA, 108 bp, Artificial Sequence
  scaffold variant
tctggcgcttttatctcattactttgagagccatcaccagcgactatgtcgtatgggtaaagcgcttatttatcggagagtaaatccgataaataagaagcatcaaag

SEQ ID NO: 1135 - DNA, 108 bp, Artificial Sequence
  scaffold variant
tactggcgcttttatcttcattactttgagagccatcaccagcgactatgtcgtatgggtaaagcgcttatttatcgcgagaaatccgataaataagaagcatcaaag

SEQ ID NO: 1136 - DNA, 107 bp, Artificial Sequence
  scaffold variant
tactggcgcttttatctcattactttgagagccatcaccagcgactatgtcgtatgggtaaagcgcttatttattgagagaaatccgataaataagaagcatcaaag

SEQ ID NO: 1137 - DNA, 107 bp, Artificial Sequence; identical to SEQ ID NO: 878
  scaffold variant

SEQ ID NO: 1138 - DNA, 108 bp, Artificial Sequence
  scaffold variant
tactggcgcttttatactcattactttgagagccatcaccagcgactatgtcgtatgggtaaagcgcttatttatcgggagaaatccgataaataagaagcatcaaag

SEQ ID NO: 1139 - DNA, 108 bp, Artificial Sequence
  scaffold variant
tactggcgcttttatcctcattactttgagagccatcaccagcgactatgtcgtatgggtaaagcgcttatttacggagagaaatccgataaataagaagcatcaaag

SEQ ID NO: 1140 - DNA, 108 bp, Artificial Sequence
  scaffold variant
tactggcgcttttatctctattactttgagagccatcaccagcgactatgtcgtatgggtaaagcgcttatttatccagagaaatccgataaataagaagcatcaaag

SEQ ID NO: 1141 - DNA, 109 bp, Artificial Sequence; identical to SEQ ID NO: 785
  scaffold variant

SEQ ID NO: 1142 - DNA, 107 bp, Artificial Sequence
  scaffold variant
tactggcgcttttatctcattactttgagagccatcaccagcgactatgtcgtatgggtaaagcgcttatttatcggagagaaatccataaataagaagcatcaaag

SEQ ID NO: 1143 - DNA, 106 bp, Artificial Sequence
  scaffold variant
tacggcgcttttatctcattactttgagagccatcaccagcgactatgtcgtatgggtaaagccttatttatcggagagaaatccgataaataagaagcatcaaag

SEQ ID NO: 1144 - DNA, 110 bp, Artificial Sequence
  scaffold variant
tactggcgcttttatctcattactttgagagccatcaccagcgactatgtcgtatgggtaaagcgcttatttattcggagagaaatcccgataaataagaagcatcaaag

SEQ ID NO: 1145 - DNA, 106 bp, Artificial Sequence
  scaffold variant
actggcgcttttatctcattactttagagccatcaccagcgactatgtcgtatgggtaaagcgcttatttatcggagagaaatccgataaataagaagcatcaaag

SEQ ID NO: 1146 - DNA, 107 bp, Artificial Sequence; identical to SEQ ID NO: 878
  scaffold variant

SEQ ID NO: 1147 - DNA, 104 bp, Artificial Sequence
  scaffold variant
ctggcgcttttatctcattactttgagagccatcaccagcgactatgtcgtatgggtaaagcgcttatttatcggagagatccgataaataagaagcatcaaag

SEQ ID NO: 1148 - DNA, 108 bp, Artificial Sequence; identical to SEQ ID NO: 487
  scaffold variant

SEQ ID NO: 1149 - DNA, 105 bp, Artificial Sequence
  scaffold variant
atggcgcttttatctcattactttgagagccatcaccagcgactatgtcgtatgggtaaagcgcttatttatcggaggaaatccgataaataagaagcatcaaag

SEQ ID NO: 1150 - DNA, 106 bp, Artificial Sequence; identical to SEQ ID NO: 1033
  scaffold variant

SEQ ID NO: 1151 - DNA, 108 bp, Artificial Sequence
  scaffold variant
tacggcgcttttatctcattactttgcagagccatcaccagcgactatgtcgtatgggtaaagcgcttatttatcggagagaaatccgataaataagaagcatcaaag

SEQ ID NO: 1152 - DNA, 109 bp, Artificial Sequence; identical to SEQ ID NO: 1025
  scaffold variant

SEQ ID NO: 1153 - DNA, 106 bp, Artificial Sequence
  scaffold variant
actggcgcttttatctcattactttgagagccatcaccagcgactatgtcgtatgggtaaagcgcttattctcggagagaaatccgataaataagaagcatcaaag

SEQ ID NO: 1154 - DNA, 109 bp, Artificial Sequence
  scaffold variant
tactggcgcttttatcttcattactttgagagccatcaccagcgactatgtcgtatgggtaaagcgcttatttatcggcgagaaatccgataaataagaagcatcaaag

SEQ ID NO: 1155 - DNA, 105 bp, Artificial Sequence
  scaffold variant
cctggcgcttttatctcattactttgagagccatcaccagcgactatgtcgtatgggtaaagcgcttatttatcggagagaaacgataaataagaagcatcaaag

SEQ ID NO: 1156 - DNA, 110 bp, Artificial Sequence
  scaffold variant
tactggcgcttttatctgcattactttgagagccatcaccagcgactatgtcgtatgggtaaagcgcttatttactcggagagaaatccgataaataagaagcatcaaag

SEQ ID NO: 1157 - DNA, 110 bp, Artificial Sequence
  scaffold variant
tactggcgcttttatcttcattactttgagagccatcaccagcgactatgtcgtatgggtaaagcgcttatttatcggagagaaatcacgataaataagaagcatcaaag

SEQ ID NO: 1158 - DNA, 109 bp, Artificial Sequence; identical to SEQ ID NO: 563
  scaffold variant

SEQ ID NO: 1159 - DNA, 105 bp, Artificial Sequence
  scaffold variant
cctggcgcttttatctcattactttgagagccatcaccagcgactatgtcgtatgggtaaagcgcttatttatcggagagatccgataaataagaagcatcaaag

SEQ ID NO: 1160 - DNA, 106 bp, Artificial Sequence
  scaffold variant
gctggcgcttttatctcattactttgagagccatcaccagcgactatgtcgtatgggtaaagcgcttatttacggagagaaatccgataaataagaagcatcaaag

SEQ ID NO: 1161 - DNA, 108 bp, Artificial Sequence
  scaffold variant
ttactggcgcttttatctcattactttgagagccatcaccagcgactatgtcgtatgggtaaagcgcttatttatcaagagaaatccgataaataagaagcatcaaag

SEQ ID NO: 1162 - DNA, 106 bp, Artificial Sequence
  scaffold variant
tggcgcttttatctcattactttgagagccatcaccagcgactatgtcgtatgggtaaagcgcttatttactcggagagaaatccgataaataagaagcatcaaag

SEQ ID NO: 1163 - DNA, 106 bp, Artificial Sequence
  scaffold variant
tacggcgcttttatctcattactttgagagccatcaccagcgactatgtcgtatgggtaaagcgcttatttatcggagagaaagcgataaataagaagcatcaaag

SEQ ID NO: 1164 - DNA, 109 bp, Artificial Sequence
  scaffold variant
tactggcgcttttatctcattactttgagagccatcaccagcgactatgtcgtatgggtaaagcgcttatttatcggagagaaatctcgataaataagaagcatcaaag

SEQ ID NO: 1165 - DNA, 104 bp, Artificial Sequence; identical to SEQ ID NO: 822
  scaffold variant

SEQ ID NO: 1166 - DNA, 109 bp, Artificial Sequence
  scaffold variant
tactggcgcttttatctcattactttgagagccatcaccagcgactatgtcgtatgggtaaagcgcttatttatcgtgagagaaatccgataaataagaagcatcaaag

SEQ ID NO: 1167 - DNA, 108 bp, Artificial Sequence
  scaffold variant
gctggcgcttttatctcattactttgagagccatcaccagcgactatgtcgtatgggtaaagcgcttatttatcgtgagagaaatccgataaataagaagcatcaaag

SEQ ID NO: 1168 - DNA, 110 bp, Artificial Sequence
  scaffold variant
tactggcgcttttatcttcattactttgagagccatcaccagcgactatgtcgtatgggtaaagcgcttatttagtcggagagaaatccgataaataagaagcatcaaag

SEQ ID NO: 1169 - DNA, 106 bp, Artificial Sequence
  scaffold variant
gctggcgcttttatctcattactttgagagccatcaccagcgactatgtcgtatgggtaaagcgcttatttatcgagagaaatccgataaataagaagcatcaaag

SEQ ID NO: 1170 - DNA, 108 bp, Artificial Sequence
  scaffold variant
tctggcgcttttatctcattactttgagagccatcaccagcgactatgtcgtatgggtaaagcgcttatttgatcggagagaaatccgataaataagaagcatcaaag

SEQ ID NO: 1171 - DNA, 106 bp, Artificial Sequence
  scaffold variant
actggcgcttttatctcattactttgagagccatcaccagcgactatgtcgtatgggtaaagcgcttatttatcgtgagaaatccgataaataagaagcatcaaag

SEQ ID NO: 1172 - DNA, 109 bp, Artificial Sequence
  scaffold variant
tactggcgcttttatctcattactttagagagccatcaccagcgactatgtcgtatgggtaaagcgcttatttatcggatttctctccgataaataagaagcatcaaag

SEQ ID NO: 1173 - DNA, 106 bp, Artificial Sequence
  scaffold variant
tactggcgcttttatctcattactttgagagccatcaccagcgactatgtcgtatgggtaaagcggtatttatcgggagaaatccgataaataagaagcatcaaag

SEQ ID NO: 1174 - DNA, 110 bp, Artificial Sequence
  scaffold variant
tactggcgcttttatcctcattactttgagagccatcaccagcgactatgtcgtatgggtaaagcgcttatttatcggagagaaatgccgataaataagaagcatcaaag

SEQ ID NO: 1175 - DNA, 108 bp, Artificial Sequence
  scaffold variant
tctggcgcttttatctcattactttgagagccatcaccagcgactatgtcgtatgggtaaagcgcttattatatcggagagaaatccgataaataagaagcatcaaag

SEQ ID NO: 1176 - DNA, 107 bp, Artificial Sequence; identical to SEQ ID NO: 878
  scaffold variant

SEQ ID NO: 1177 - DNA, 109 bp, Artificial Sequence
  scaffold variant
tactggcgcttttatctcattactttgagagccatcaccagcgactatgtcgtatgggtaaagcgcttatttatcgcgagagaaatccgataaataagaagcatcaaag

SEQ ID NO: 1178 - DNA, 107 bp, Artificial Sequence; identical to SEQ ID NO: 431
  scaffold variant

SEQ ID NO: 1179 - DNA, 108 bp, Artificial Sequence
  scaffold variant
ctactggcgcttttatctcattactttgagagccatcaccagcgactatgtcgtatgggtaaagcgcttatttatcggagagaaatccataaataagaagcatcaaag

SEQ ID NO: 1180 - DNA, 106 bp, Artificial Sequence
  scaffold variant
actggcgcttttatctcattactttgagagccatcaccagcgactatgtcgtatgggtaaagcgcttatttatcggagagaaaccgataaataagaagcatcaaag

SEQ ID NO: 1181 - DNA, 106 bp, Artificial Sequence; identical to SEQ ID NO: 446
  scaffold variant

SEQ ID NO: 1182 - DNA, 107 bp, Artificial Sequence
  scaffold variant
tactggcgcttttatctcattactttgagagccatcaccagcgactatgtcgtatgggtaaagcgcttatttatcggagagaaatccgtaaataagaagcatcaaag

SEQ ID NO: 1183 - DNA, 108 bp, Artificial Sequence
  scaffold variant
cctggcgcttttatctcattactttgagagccatcaccagcgactatgtcgtatgggtaaagcgcttatttatcggagagcaaatccgataaataagaagcatcaaag

SEQ ID NO: 1184 - DNA, 105 bp, Artificial Sequence
  scaffold variant
ctggcgcttttatctcattactttgagagccatcaccagcgactatgtcgtatgggtaaagcgcttatttatcggagagattccgataaataagaagcatcaaag

SEQ ID NO: 1185 - DNA, 108 bp, Artificial Sequence
  scaffold variant
tactggcgcttttatctctattactttgagagccatcaccagcgactatgtcgtatgggtaaagcgcttatttatcggagataatccgataaataagaagcatcaaag

SEQ ID NO: 1186 - DNA, 109 bp, Artificial Sequence; identical to SEQ ID NO: 1093
  scaffold variant

SEQ ID NO: 1187 - DNA, 108 bp, Artificial Sequence
  scaffold variant
tctggcgcttttatctcattactttgagagccatcaccagcgactatgtcgtatgggtaaagcgcttatttatcggagagaaatccgataaataagagagcatcaaag

SEQ ID NO: 1188 - DNA, 105 bp, Artificial Sequence; identical to SEQ ID NO: 424
  scaffold variant

SEQ ID NO: 1189 - DNA, 110 bp, Artificial Sequence
  scaffold variant
tactggcgcttttatcctcattactttgagagccatcaccagcgactatgtcgtatgggtaaagcgcttatttatcaggagagaaatccgataaataagaagcatcaaag

SEQ ID NO: 1190 - DNA, 109 bp, Artificial Sequence
  scaffold variant
tactggcgcttttatctcattactttgagagccatcaccagcgactatgtcgtatgggtaaagcgcttatttatcgagagagaaatccgataaataagaagcatcaaag

SEQ ID NO: 1191 - DNA, 110 bp, Artificial Sequence
  scaffold variant
tactggcgcttttatctcattactttgagagccatcaccagcgactatgtcgtattgggtaaagcgcttatttatcggagagaaatcgcgataaataagaagcatcaaag

SEQ ID NO: 1192 - DNA, 107 bp, Artificial Sequence
  scaffold variant
cctggcgcttttatctcattactttgagagccatcaccagcgactatgtcgtatgggtaaagcgcttatttatcggagagaaatctgataaataagaagcatcaaag

SEQ ID NO: 1193 - DNA, 108 bp, Artificial Sequence
  scaffold variant
tactggcgcttttatcctcattactttgagagccatcaccagcgactatgtcgtatgggtaaagcgcttatttatcaagagaaatccgataaataagaagcatcaaag

SEQ ID NO: 1194 - DNA, 110 bp, Artificial Sequence
  scaffold variant
tactggcgcttttatctcattactttgagagccatcaccagcgactatgtcgtatgggtaaagcgcttatttatacggagagaaatcgcgataaataagaagcatcaaag

SEQ ID NO: 1195 - DNA, 105 bp, Artificial Sequence; identical to SEQ ID NO: 925
  scaffold variant

SEQ ID NO: 1196 - DNA, 108 bp, Artificial Sequence
  scaffold variant
tactggcgcttttattctcattactttgagagccatcaccagcgactatgtcgtatgggtaaagcgcttatttatcgcgagaaatccgataaataagaagcatcaaag

SEQ ID NO: 1197 - DNA, 106 bp, Artificial Sequence
  scaffold variant
atggcgcttttatctcattactttgagagccatcaccagcgactatgtcgtatgggtaaagcgcttatttatcggagagaaatccgataaataagaagcatcaaag

SEQ ID NO: 1198 - DNA, 108 bp, Artificial Sequence
  scaffold variant
tactggcgcttttatctcgattactttgagagccatcaccagcgactatgtcgtatgggtaaagcgcttattttcggagagaaatccgataaataagaagcatcaaag

SEQ ID NO: 1199 - DNA, 106 bp, Artificial Sequence
  scaffold variant
tactggcgcttttatctcattactttgagagccatcaccagcgactatgtcgtatgggtaaagcgcttatttatcggagagaaacgataaataagaagcatcaaag

SEQ ID NO: 1200 - DNA, 110 bp, Artificial Sequence
  scaffold variant
tacctggcgcttttatctcattactttgagagccatcaccagcgactatgtcgtatgggtaaagcgcttatttatcggagagaaatcgcgataaataagaagcatcaaag

SEQ ID NO: 1201 - DNA, 109 bp, Artificial Sequence; identical to SEQ ID NO: 1025
  scaffold variant

SEQ ID NO: 1202 - DNA, 108 bp, Artificial Sequence
  scaffold variant
tacctggcgcttttatctcattactttgagagccatcaccagcgactatgtcgtatgggtaaagcgcttatttatctagagaaatccgataaataagaagcatcaaag

SEQ ID NO: 1203 - DNA, 105 bp, Artificial Sequence
  scaffold variant
ggcgcttttatctcattactttgagagccatcaccagcgactatgtcgtatgggtaaagcgcttatttatccggagagaaatccgataaataagaagcatcaaag

SEQ ID NO: 1204 - DNA, 110 bp, Artificial Sequence
  scaffold variant
atactggcgcttttatctcattactttgagagccatcaccagcgactatgtcgtatgggtaaagcgcttatttatcggagagaaatcacgataaataagaagcatcaaag

SEQ ID NO: 1205 - DNA, 107 bp, Artificial Sequence; identical to SEQ ID NO: 623
  scaffold variant

SEQ ID NO: 1206 - DNA, 106 bp, Artificial Sequence
  scaffold variant
gctggcgcttttatctcattactttgagagccatcaccagcgactatgtcgtatgggtaaagcgcttatttatcgggagaaatccgataaataagaagcatcaaag

SEQ ID NO: 1207 - DNA, 107 bp, Artificial Sequence
  scaffold variant
cctggcgcttttatctcattactttgagagccatcaccagcgactatgtcgtatgggtaaagcgcttatttttcggagagaaatccgataaataagaagcatcaaag

SEQ ID NO: 1208 - DNA, 110 bp, Artificial Sequence
  scaffold variant
tactggcgcttttatctacattactttgagagccatcaccagcgactatgtcgtatgggtaaagcgcttatttatcggagagaaatcccgataaataagaagcatcaaag

SEQ ID NO: 1209 - DNA, 106 bp, Artificial Sequence
  scaffold variant
tctggcgcttttatctcattactttgagagccatcaccagcgactatgtcgtatgggtaaagcggtatttatcggagagaaatccgataaataagaagcatcaaag

SEQ ID NO: 1210 - DNA, 109 bp, Artificial Sequence
  scaffold variant
tactggcgcttttatctcattactttgagagccatcaccagcgactatgtcgtatgggtaaagcgcttatttatcggagagaaatccgaataaataagaagcatcaaag

SEQ ID NO: 1211 - DNA, 108 bp, Artificial Sequence
  scaffold variant
tactggcgcttttatcatcattactttgagagccatcaccagcgactatgtcgtatgggtaaagcgcttatttatctagagaaatccgataaataagaagcatcaaag

SEQ ID NO: 1212 - DNA, 105 bp, Artificial Sequence
  scaffold variant
cctggcgcttttatctcattactttgagagccatcaccagcgactatgtcgtatgggtaaagcgcttatttaggagagaaatccgataaataagaagcatcaaag

SEQ ID NO: 1213 - DNA, 110 bp, Artificial Sequence
  scaffold variant
ttactggcgcttttatctcattactttgagagccatcaccagcgactatgtcgtatgggtaaagcgcttatttactcggagagaaatccgataaataagaagcatcaaag

SEQ ID NO: 1214 - DNA, 107 bp, Artificial Sequence; identical to SEQ ID NO: 1035
  scaffold variant

SEQ ID NO: 1215 - DNA, 110 bp, Artificial Sequence
  scaffold variant
ctactggcgcttttatctcattactttgagagccatcaccagcgactatgtcgtatgggtaaagcgcttatttatctggagagaaatccgataaataagaagcatcaaag

SEQ ID NO: 1216 - DNA, 107 bp, Artificial Sequence; identical to SEQ ID NO: 970
  scaffold variant

SEQ ID NO: 1217 - DNA, 107 bp, Artificial Sequence; identical to SEQ ID NO: 562
  scaffold variant

SEQ ID NO: 1218 - DNA, 110 bp, Artificial Sequence
  scaffold variant
tactggcgcttttatctctattactttgagagccatcaccagcgactatgtcgtatgggtaaagcgcttatttatcgggagagaaatccgataaataagaagcatcaaag

SEQ ID NO: 1219 - DNA, 109 bp, Artificial Sequence; identical to SEQ ID NO: 1025
  scaffold variant

SEQ ID NO: 1220 - DNA, 107 bp, Artificial Sequence
  scaffold variant
atggcgcttttatctcattactttgagagccatcaccagcgactatgtcgtatgggtaaagcgcttatttatcggcagagaaatccgataaataagaagcatcaaag

SEQ ID NO: 1221 - DNA, 109 bp, Artificial Sequence; identical to SEQ ID NO: 957
  scaffold variant

SEQ ID NO: 1222 - DNA, 109 bp, Artificial Sequence
  scaffold variant
tactggcgcttttatctcattactttgagagccatcaccagcgactatgtcgtatgggtaaagcgcttatttatcggagagaaatgccgataaataagaagcatcaaag

SEQ ID NO: 1223 - DNA, 107 bp, Artificial Sequence; identical to SEQ ID NO: 1136
  scaffold variant

SEQ ID NO: 1224 - DNA, 110 bp, Artificial Sequence
  scaffold variant
tactggcgcttttatctcattactttagagagccatcaccagcgactatgtcgtatgggtaaagcgcttattctatcggagagaaatccgataaataagaagcatcaaag

SEQ ID NO: 1225 - DNA, 105 bp, Artificial Sequence
  scaffold variant
cctggcgcttttatctcattactttgagagccatcaccagcgactatgtcgtatgggtaaagcgcttatttatcggagagttccgataaataagaagcatcaaag

SEQ ID NO: 1226 - DNA, 108 bp, Artificial Sequence
  scaffold variant
ttactggcgcttttatctcattactttgagagccatcaccagcgactatgtcgtatgggtaaagcgcttatttatcgggagaaatccgataaataagaagcatcaaag

SEQ ID NO: 1227 - DNA, 104 bp, Artificial Sequence
  scaffold variant
tggcgcttttatctcattactttgagagccatcaccagcgactatgtcgtatgggtaaagcgcttatttatcggagagaaatcgataaataagaagcatcaaag

SEQ ID NO: 1228 - DNA, 109 bp, Artificial Sequence
  scaffold variant
tactggcgcttttatctcattactttgagagccatcaccagcgactatgtcgtatgggtaaagcgcttatttatcgggagagaaatccgataaataagaagcatcaaag

SEQ ID NO: 1229 - DNA, 108 bp, Artificial Sequence
  scaffold variant
tactggcgcttttatcctcattactttgagagccatcaccagcgactatgtcgtatgggtaaagcgcttatttattgagagaaatccgataaataagaagcatcaaag

SEQ ID NO: 1230 - DNA, 110 bp, Artificial Sequence
  scaffold variant
tactggcgcttttatcttcattactttgagagccatcaccagcgactatgtcgtatgggtaaagcgcttatttatacggagagaaatccgataaataagaagcatcaaag

SEQ ID NO: 1231 - DNA, 107 bp, Artificial Sequence
  scaffold variant
tactggcgcttttattctcattactttgagagccatcaccagcgactatgtcgtatgggtaaagcgcttatttatcggagaaatccgataaataagaagcatcaaag

SEQ ID NO: 1232 - DNA, 107 bp, Artificial Sequence
  scaffold variant
tactggcgcttttatcttcattactttgagagccatcaccagcgactatgtcgtatgggtaaagcgcttatttatcggagagatccgataaataagaagcatcaaag

SEQ ID NO: 1233 - DNA, 108 bp, Artificial Sequence
  scaffold variant
actggcgcttttattctcattactttgagagccatcaccagcgactatgtcgtatgggtaaagcgcttatttatcggagagaaatccgataaataagaagcatcaaag

SEQ ID NO: 1234 - DNA, 106 bp, Artificial Sequence
  scaffold variant
ctggcgcttttatctcattactttgagagccatcaccagcgactatgtcgtatgggtaaagcgcttatttatcggtgagaaatccgataaataagaagcatcaaag

SEQ ID NO: 1235 - DNA, 110 bp, Artificial Sequence
  scaffold variant
tactggcgcttttatctcattactttcgagagccatcaccagcgactatgtcgtatgggtaaagcgcttattctatcggagagaaatccgataaataagaagcatcaaag

SEQ ID NO: 1236 - DNA, 107 bp, Artificial Sequence
  scaffold variant
actggcgcttttatctcattactttgagagccatcaccagcgactatgtcgtatgggtaaagcgcttatttatcggtgagaaatccgataaataagaagcatcaaag

SEQ ID NO: 1237 - DNA, 107 bp, Artificial Sequence; identical to SEQ ID NO: 1035
  scaffold variant

SEQ ID NO: 1238 - DNA, 108 bp, Artificial Sequence
  scaffold variant
gctggcgcttttatctcattactttgagagccatcaccagcgactatgtcgtatgggtaaagcgcttatttatcggagagaaatgccgataaataagaagcatcaaag

SEQ ID NO: 1239 - DNA, 110 bp, Artificial Sequence
  scaffold variant
tactggcgcttttatctcattactttgagagccatcaccagcgactatgtcgtatgggtaaagcgcttatttatccggagagaaatcgcgataaataagaagcatcaaag

SEQ ID NO: 1240 - DNA, 108 bp, Artificial Sequence
  scaffold variant
tactggcgcttttatctgcattactttgagagccatcaccagcgactatgtcgtatgggtaaagcgcttatttatagagagaaatccgataaataagaagcatcaaag

SEQ ID NO: 1241 - DNA, 109 bp, Artificial Sequence
  scaffold variant
tactggcgcttttatctcattactttgagagccatcaccagcgactatgtcgtatgggtaaagcgcttatttatcggagagaaataccgataaataagaagcatcaaag

SEQ ID NO: 1242 - DNA, 108 bp, Artificial Sequence
  scaffold variant
tactggcgcttttatcttcattactttgagagccatcaccagcgactatgtcgtatgggtaaagcgcttatttatcgtgagaaatccgataaataagaagcatcaaag

SEQ ID NO: 1243 - DNA, 106 bp, Artificial Sequence
  scaffold variant
actggcgcttttatctcattactttgagagccatcaccagcgactatgtcgtatgggtaaagcgcttatttccggagagaaatccgataaataagaagcatcaaag

SEQ ID NO: 1244 - DNA, 109 bp, Artificial Sequence; identical to SEQ ID NO: 785
  scaffold variant

SEQ ID NO: 1245 - DNA, 109 bp, Artificial Sequence; identical to SEQ ID NO: 785
  scaffold variant

SEQ ID NO: 1246 - DNA, 108 bp, Artificial Sequence
  scaffold variant
tactggcgcttttatctcattactttgagagccatcaccagcgactatgtcgtatgggtaaagcgcttatttatgcggagagaaatccataaataagaagcatcaaag

SEQ ID NO: 1247 - DNA, 108 bp, Artificial Sequence
  scaffold variant
tactggcgcttttatctctattactttgagagccatcaccagcgactatgtcgtatgggtaaagcgcttatttatctagagaaatccgataaataagaagcatcaaag

SEQ ID NO: 1248 - DNA, 110 bp, Artificial Sequence
  scaffold variant
tactggcgcttttatctctattactttgagagccatcaccagcgactatgtcgtatgggtaaagcgcttatttattcggagagaaatccgataaataagaagcatcaaag

SEQ ID NO: 1249 - DNA, 110 bp, Artificial Sequence
  scaffold variant
tactggcgcttttatctcgattactttgagagccatcaccagcgactatgtcgtatgggtaaagcgcttatttatcggagagaaatcacgataaataagaagcatcaaag

SEQ ID NO: 1250 - DNA, 108 bp, Artificial Sequence
  scaffold variant
tactggcgcttttatctgcattactttgagagccatcaccagcgactatgtcgtatgggtaaagcgcttatttatcgcgagaaatccgataaataagaagcatcaaag

SEQ ID NO: 1251 - DNA, 106 bp, Artificial Sequence
  scaffold variant
actggcgcttttatctcattactttgagagccatcaccagcgactatgtcgtatgggtaaagcgcttatttatcggagagaatccgataaataagaagcatcaaag

SEQ ID NO: 1252 - DNA, 107 bp, Artificial Sequence
  scaffold variant
cctggcgcttttatctcattactttgagagccatcaccagcgactatgtcgtatgggtaaagcgcttatttatcggagagaaatccgatgaataagaagcatcaaag

SEQ ID NO: 1253 - DNA, 110 bp, Artificial Sequence
  scaffold variant
tactggcgcttttatcctcattactttgagagccatcaccagcgactatgtcgtatgggtaaagcgcttatttatcgggagagaaatccgataaataagaagcatcaaag

SEQ ID NO: 1254 - DNA, 108 bp, Artificial Sequence
  scaffold variant
tactggcgcttttaatctcattactttgagagccatcaccagcgactatgtcgtatgggtaaagcgcttatttatcaagagaaatccgataaataagaagcatcaaag

SEQ ID NO: 1255 - DNA, 107 bp, Artificial Sequence
  scaffold variant
ctggcgcttttatcttcattactttgagagccatcaccagcgactatgtcgtatgggtaaagcgcttatttatcggagagaaatccgataaataagaagcatcaaag

SEQ ID NO: 1256 - DNA, 108 bp, Artificial Sequence
  scaffold variant
tactggcgcttttattctcattactttgagagccatcaccagcgactatgtcgtatgggtaaagcgcttatttccggagagaaatccgataaataagaagcatcaaag

SEQ ID NO: 1257 - DNA, 108 bp, Artificial Sequence
  scaffold variant
tactggcgcttttatctctattactttgagagccatcaccagcgactatgtcgtatgggtaaagcgcttatttatcggaagaaatccgataaataagaagcatcaaag

SEQ ID NO: 1258 - DNA, 107 bp, Artificial Sequence; identical to SEQ ID NO: 1081
  scaffold variant

SEQ ID NO: 1259 - DNA, 107 bp, Artificial Sequence; identical to SEQ ID NO: 878
  scaffold variant

SEQ ID NO: 1260 - DNA, 109 bp, Artificial Sequence; identical to SEQ ID NO: 957
  scaffold variant

SEQ ID NO: 1261 - DNA, 110 bp, Artificial Sequence
  scaffold variant
tactggcgcttttattctcattactttgagagccatcaccagcgactatgtcgtatgggtaaagcgcttattgtatcggagagaaatccgataaataagaagcatcaaag

SEQ ID NO: 1262 - DNA, 105 bp, Artificial Sequence
  scaffold variant
tacggcgcttttatctcattactttgagagccatcaccagcgactatgtcgtatgggtaaagcgcttatttatcggagagaaccgataaataagaagcatcaaag

SEQ ID NO: 1263 - DNA, 107 bp, Artificial Sequence
  scaffold variant
tactggcgcttttatctcattactttgagagccatcaccagcgactatgtcgtatgggtaaagcgcttatttatcggagagaaatcgataaataagaagcatcaaag

SEQ ID NO: 1264 - DNA, 109 bp, Artificial Sequence; identical to SEQ ID NO: 785
  scaffold variant

SEQ ID NO: 1265 - DNA, 109 bp, Artificial Sequence; identical to SEQ ID NO: 1055
  scaffold variant

SEQ ID NO: 1266 - DNA, 109 bp, Artificial Sequence; identical to SEQ ID NO: 785
  scaffold variant

SEQ ID NO: 1267 - DNA, 108 bp, Artificial Sequence
  scaffold variant
tacggcgcttttatctcattactttgagagccatcaccagcgactatgtcgtatgggtaaagcgcttatttatcggagagcaaatccgataaataagaagcatcaaag

SEQ ID NO: 1268 - DNA, 105 bp, Artificial Sequence; identical to SEQ ID NO: 743
  scaffold variant

SEQ ID NO: 1269 - DNA, 110 bp, Artificial Sequence
  scaffold variant
tactggcgcttttatcgtcattactttgagagccatcaccagcgactatgtcgtatgggtaaagcgcttatttatacggagagaaatccgataaataagaagcatcaaag

SEQ ID NO: 1270 - DNA, 108 bp, Artificial Sequence
  scaffold variant
tactggcgcttttatctgcattactttgagagccatcaccagcgactatgtcgtatgggtaaagcgcttatttatcaagagaaatccgataaataagaagcatcaaag

SEQ ID NO: 1271 - DNA, 108 bp, Artificial Sequence
  scaffold variant
tactggcgcttttatcctcattactttgagagccatcaccagcgactatgtcgtatgggtaaagcgcttatttatccagagaaatccgataaataagaagcatcaaag

SEQ ID NO: 1272 - DNA, 110 bp, Artificial Sequence
  scaffold variant
tactggcgcttttatctcgattactttgagagccatcaccagcgactatgtcgtatgggtaaagcgcttatttatcggagagaaataccgataaataagaagcatcaaag

SEQ ID NO: 1273 - DNA, 120 bp, Artificial Sequence
  scaffold variant
tactggcgcttttatctcattactttgctcattactttgagagccatcaccagcgactatgtcgtatgggtaaagcgcttatttatcggagagaaatccgataaataagaagcatcaaag

SEQ ID NO: 1274 - DNA, 104 bp, Artificial Sequence; identical to SEQ ID NO: 654
  scaffold variant

SEQ ID NO: 1275 - DNA, 106 bp, Artificial Sequence; identical to SEQ ID NO: 816
  scaffold variant

SEQ ID NO: 1276 - DNA, 108 bp, Artificial Sequence
  scaffold variant
actggcgcttttatctcattactttgagagccatcaccagcgactatgtcgtattgggtaaagcgcttatttatcggagagaaatccgataaataagaagcatcaaag

SEQ ID NO: 1277 - DNA, 110 bp, Artificial Sequence
  scaffold variant
tactggcgcttttatctcattactttgagagccatcaccagcgactatgtcgtatgggtaaagcgcttatttatgcggagagaaatccgaataaataagaagcatcaaag

SEQ ID NO: 1278 - DNA, 109 bp, Artificial Sequence; identical to SEQ ID NO: 882
  scaffold variant

SEQ ID NO: 1279 - DNA, 108 bp, Artificial Sequence
  scaffold variant
tactggcgcttttatctcattactttgagagccatcaccagcgactatgtcgtatgggtaaagcgcttatttgtcggagagaaatccgataaataagaagcatcaaag

SEQ ID NO: 1280 - DNA, 106 bp, Artificial Sequence
  scaffold variant
gctggcgcttttatctcattactttgagagccatcaccagcgactatgtcgtatgggtaaagcgcttatttatggagagaaatccgataaataagaagcatcaaag

SEQ ID NO: 1281 - DNA, 106 bp, Artificial Sequence
  scaffold variant
cctggcgcttttatctcattactttgagagccatcaccagcgactatgtcgtatgggtaaagcgcttatttatcggagagaaatccgatgataagaagcatcaaag

SEQ ID NO: 1282 - DNA, 108 bp, Artificial Sequence
  scaffold variant
gctggcgcttttatctcattactttgagagccatcaccagcgactatgtcgtatgggtaaagcgcttatttatcggagagaaatctcgataaataagaagcatcaaag

SEQ ID NO: 1283 - DNA, 108 bp, Artificial Sequence
  scaffold variant
cctggcgcttttaatctcattactttgagagccatcaccagcgactatgtcgtatgggtaaagcgcttatttatcggagagaaatccgataaataagaagcatcaaag

SEQ ID NO: 1284 - DNA, 109 bp, Artificial Sequence; identical to SEQ ID NO: 563
  scaffold variant

SEQ ID NO: 1285 - DNA, 110 bp, Artificial Sequence
  scaffold variant
ttactggcgcttttatctcattactttgagagccatcaccagcgactatgtcgtatgggtaaagcgcttatttagtcggagagaaatccgataaataagaagcatcaaag

SEQ ID NO: 1286 - DNA, 110 bp, Artificial Sequence
  scaffold variant
tactggcgcttttatctctattactttgagagccatcaccagcgactatgtcgtagtgggtaaagcgcttatttatcggagagaaatccgataaataagaagcatcaaag

SEQ ID NO: 1287 - DNA, 110 bp, Artificial Sequence
  scaffold variant
tactggcgcttttatctcattactttgagagccatcaccagcgactatgtcgtatgggtaaagcgcttatttatgcggagagaaatccgataaataagaaagcatcaaag

SEQ ID NO: 1288 - DNA, 110 bp, Artificial Sequence
  scaffold variant
tactggcgcttttatctcattactttcgagagccatcaccagcgactatgtcgtatgggtaaagcgcttatttatcggagagaaatccgagtaaataagaagcatcaaag

SEQ ID NO: 1289 - DNA, 107 bp, Artificial Sequence; identical to SEQ ID NO: 1035
  scaffold variant

SEQ ID NO: 1290 - DNA, 106 bp, Artificial Sequence
  scaffold variant
cctggcgcttttatctcattactttgagagccatcaccagcgactatgtcgtatgggtaaagcgttatttatcggagagaaatccgataaataagaagcatcaaag

SEQ ID NO: 1291 - DNA, 104 bp, Artificial Sequence
  scaffold variant
ctggcgcttttatctcattactttgagagccatcaccagcgactatgtcgtatgggtaaagcgcttatttatcggagatatccgataaataagaagcatcaaag

SEQ ID NO: 1292 - DNA, 107 bp, Artificial Sequence; identical to SEQ ID NO: 578
  scaffold variant

SEQ ID NO: 1293 - DNA, 108 bp, Artificial Sequence
  scaffold variant
tcactggcgcttttatctcattactttgagagccatcaccagcgactatgtcgtatgggtaaagcgcttatttatcgagagaaatccgataaataagaagcatcaaag

SEQ ID NO: 1294 - DNA, 107 bp, Artificial Sequence; identical to SEQ ID NO: 878
  scaffold variant

SEQ ID NO: 1295 - DNA, 109 bp, Artificial Sequence; identical to SEQ ID NO: 847
  scaffold variant

SEQ ID NO: 1296 - DNA, 110 bp, Artificial Sequence
  scaffold variant
tactggcgcttttatctcattactttcgagagccatcaccagcgactatgtcgtatgggtaaagcgcttattatatcggagagaaatccgataaataagaagcatcaaag

SEQ ID NO: 1297 - DNA, 108 bp, Artificial Sequence
  scaffold variant
tacggcgcttttatctcattactttgagagccatcaccagcgactatgtcgtatgggtaaagcgcttattctatcggagagaaatccgataaataagaagcatcaaag

SEQ ID NO: 1298 - DNA, 108 bp, Artificial Sequence
  scaffold variant
tactggcgcttttattctcattactttgagagccatcaccagcgactatgtcgtatgggtaaagcgcttatttatcgtgagaaatccgataaataagaagcatcaaag

SEQ ID NO: 1299 - DNA, 106 bp, Artificial Sequence
  scaffold variant
gctggcgcttttatctcattactttgagagccatcaccagcgactatgtcgtatgggtaaagcgcttatttatcggagataatccgataaataagaagcatcaaag

SEQ ID NO: 1300 - DNA, 108 bp, Artificial Sequence
  scaffold variant
tactggcgcttttattctcattactttgagagccatcaccagcgactatgtcgtatgggtaaagcgcttatttattgagagaaatccgataaataagaagcatcaaag

SEQ ID NO: 1301 - DNA, 108 bp, Artificial Sequence
  scaffold variant
cctggcgcttttatctcattactttgagagccatcaccagcgactatgtcgtatgggtaaagcgcttattctatcggagagaaatccgataaataagaagcatcaaag

SEQ ID NO: 1302 - DNA, 107 bp, Artificial Sequence
  scaffold variant
tctggcgcttttatctcattactttgagagccatcaccagcgactatgtcgtatgggtaaagcgcttatttagcggagagaaatccgataaataagaagcatcaaag

SEQ ID NO: 1303 - DNA, 107 bp, Artificial Sequence; identical to SEQ ID NO: 552
  scaffold variant

SEQ ID NO: 1304 - DNA, 110 bp, Artificial Sequence
  scaffold variant
tactggcgcttttatctcattactttagagagccatcaccagcgactatgtcgtatgggtaaagcgcttatttatcggtagagaaatccgataaataagaagcatcaaag

SEQ ID NO: 1305 - DNA, 110 bp, Artificial Sequence
  scaffold variant
tactggcgcttttaatctcattactttgagagccatcaccagcgactatgtcgtatgggtaaagcgcttatttatcggcagagaaatccgataaataagaagcatcaaag

SEQ ID NO: 1306 - DNA, 110 bp, Artificial Sequence
  scaffold variant
tactggcgcttttatctcattactttgagagccatcaccagcgactatgtcgtatgggtaaagcgcttatttatgcggagagaaatccggataaataagaagcatcaaag

SEQ ID NO: 1307 - DNA, 107 bp, Artificial Sequence
  scaffold variant
cctggcgcttttatctcattactttgagagccatcaccagcgactatgtcgtatgggtaaagcgcttatttatcggagagaaatccgataaataagaagcatcaaag

SEQ ID NO: 1308 - DNA, 107 bp, Artificial Sequence
  scaffold variant
cctggcgcttttatctcattactttgagagccatcaccagcgactatgtcgtatgggtaaagcgcttatttatcggagagaaatccggtaaataagaagcatcaaag

SEQ ID NO: 1309 - DNA, 107 bp, Artificial Sequence
  scaffold variant
tacggcgcttttatctcattactttgagagccatcaccagcgactatgtcgtatgggtaaagcgcttatttatcggagaggaatccgataaataagaagcatcaaag

SEQ ID NO: 1310 - DNA, 105 bp, Artificial Sequence
  scaffold variant
tacggcgcttttatctcattactttgagagccatcaccagcgactatgtcgtatgggtaaagcgcttatttatcggggaaatccgataaataagaagcatcaaag

SEQ ID NO: 1311 - DNA, 110 bp, Artificial Sequence
  scaffold variant
taactggcgcttttatctcattactttgagagccatcaccagcgactatgtcgtatgggtaaagcgcttatttatcggagagaaatctcgataaataagaagcatcaaag

SEQ ID NO: 1312 - DNA, 110 bp, Artificial Sequence
  scaffold variant
tactggcgcttttatcttcattactttgagagccatcaccagcgactatgtcgtatgggtaaagcgcttatttatctggagagaaatccgataaataagaagcatcaaag

SEQ ID NO: 1313 - DNA, 110 bp, Artificial Sequence
  scaffold variant
tactggcgcttttatcgtcattactttgagagccatcaccagcgactatgtcgtatgggtaaagcgcttatttattcggagagaaatccgataaataagaagcatcaaag

SEQ ID NO: 1314 - DNA, 108 bp, Artificial Sequence
  scaffold variant
cctggcgcttttatctcattactttgagagccatcaccagcgactatgtcgtatgggtaaagcgcttatttgatcggagagaaatccgataaataagaagcatcaaag

SEQ ID NO: 1315 - DNA, 107 bp, Artificial Sequence; identical to SEQ ID NO: 528
  scaffold variant

SEQ ID NO: 1316 - DNA, 107 bp, Artificial Sequence; identical to SEQ ID NO: 1081
  scaffold variant

SEQ ID NO: 1317 - DNA, 109 bp, Artificial Sequence; identical to SEQ ID NO: 1055
  scaffold variant

SEQ ID NO: 1318 - DNA, 107 bp, Artificial Sequence
  scaffold variant
actggcgcttttatctcattactttgagagccatcaccagcgactatgtcgtatgggtaaagcgcttatttatcggatttctctccgataaataagaagcatcaaag

SEQ ID NO: 1319 - DNA, 108 bp, Artificial Sequence
  scaffold variant
atactggcgcttttatctcattactttgagagccatcaccagcgactatgtcgtatgggtaaagcgcttatttatcaagagaaatccgataaataagaagcatcaaag

SEQ ID NO: 1320 - DNA, 107 bp, Artificial Sequence; identical to SEQ ID NO: 1035
  scaffold variant

SEQ ID NO: 1321 - DNA, 107 bp, Artificial Sequence; identical to SEQ ID NO: 1307
  scaffold variant

SEQ ID NO: 1322 - DNA, 107 bp, Artificial Sequence; identical to SEQ ID NO: 1136
  scaffold variant

SEQ ID NO: 1323 - DNA, 109 bp, Artificial Sequence; identical to SEQ ID NO: 563
  scaffold variant

SEQ ID NO: 1324 - DNA, 108 bp, Artificial Sequence; identical to SEQ ID NO: 419
  scaffold variant

SEQ ID NO: 1325 - DNA, 108 bp, Artificial Sequence
  scaffold variant
tactggcgcttttatctgcattactttgagagccatcaccagcgactatgtcgtatgggtaaagcgcttatttatcggagagaaatcgataaataagaagcatcaaag

SEQ ID NO: 1326 - DNA, 106 bp, Artificial Sequence
  scaffold variant
actggcgcttttatctcattactttgagagccatcaccagcgactatgtcgtatgggtaaagcattatttatcggagagaaatccgataaataagaagcatcaaag

SEQ ID NO: 1327 - DNA, 105 bp, Artificial Sequence
  scaffold variant
tctggcgcttttatctcattactttgagagccatcaccagcgactatgtcgtatgggtaaagcgcttatttatcggaggaatccgataaataagaagcatcaaag

SEQ ID NO: 1328 - DNA, 106 bp, Artificial Sequence; identical to SEQ ID NO: 532
  scaffold variant

SEQ ID NO: 1329 - DNA, 106 bp, Artificial Sequence; identical to SEQ ID NO: 1046
  scaffold variant

SEQ ID NO: 1330 - DNA, 110 bp, Artificial Sequence
  scaffold variant
tactggcgcttttatctctattactttgagagccatcaccagcgactatgtcgtatgggtaaagcgcttatttagtcggagagaaatccgataaataagaagcatcaaag

SEQ ID NO: 1331 - DNA, 107 bp, Artificial Sequence
  scaffold variant
tactggcgcttttatctcattactttgagagccatcaccagcgactatgtcgtatgggtaaagcgcttatttatcggagagattccgataaataagaagcatcaaag

SEQ ID NO: 1332 - DNA, 107 bp, Artificial Sequence
  scaffold variant
ctggcgcttttattctcattactttgagagccatcaccagcgactatgtcgtatgggtaaagcgcttatttatcggagagaaatccgataaataagaagcatcaaag

SEQ ID NO: 1333 - DNA, 107 bp, Artificial Sequence; identical to SEQ ID NO: 960
  scaffold variant

SEQ ID NO: 1334 - DNA, 109 bp, Artificial Sequence; identical to SEQ ID NO: 955
  scaffold variant

SEQ ID NO: 1335 - DNA, 108 bp, Artificial Sequence
  scaffold variant
tactggcgcttttatctctattactttgagagccatcaccagcgactatgtcgtatgggtaaagcgcttatttatcgggagaaatccgataaataagaagcatcaaag

SEQ ID NO: 1336 - DNA, 107 bp, Artificial Sequence; identical to SEQ ID NO: 1136
  scaffold variant

SEQ ID NO: 1337 - DNA, 106 bp, Artificial Sequence
  scaffold variant
tactggcgcttttatctattactttgagagccatcaccagcgactatgtcgtatgggtaaagcgcttatttatctagagaaatccgataaataagaagcatcaaag

SEQ ID NO: 1338 - DNA, 110 bp, Artificial Sequence
  scaffold variant
tactggcgcttttatctcattactttgagagccatcaccagcgactatgtcgtatgggtaaagcgcttatttatcgggagagaaatcccgataaataagaagcatcaaag

SEQ ID NO: 1339 - DNA, 105 bp, Artificial Sequence; identical to SEQ ID NO: 551
  scaffold variant

SEQ ID NO: 1340 - DNA, 106 bp, Artificial Sequence
  scaffold variant
tggcgcttttatctcattactttgagagccatcaccagcgactatgtcgtatgggtaaagcgcttatttatcgggagagaaatccgataaataagaagcatcaaag

SEQ ID NO: 1341 - DNA, 110 bp, Artificial Sequence
  scaffold variant
tactggcgcttttatctgcattactttgagagccatcaccagcgactatgtcgtatgggtaaagcgcttatttatccggagagaaatccgataaataagaagcatcaaag

SEQ ID NO: 1342 - DNA, 110 bp, Artificial Sequence
  scaffold variant
tactggcgcttttatctacattactttgagagccatcaccagcgactatgtcgtatgggtaaagcgcttatttatcgggagagaaatccgataaataagaagcatcaaag

SEQ ID NO: 1343 - DNA, 108 bp, Artificial Sequence
  scaffold variant
tactggcgcttttatctcattactttgagagccatcaccagcgactatgtcgtatgggtaaagcggtatttatcgggagagaaatccgataaataagaagcatcaaag

SEQ ID NO: 1344 - DNA, 108 bp, Artificial Sequence
  scaffold variant
tactggcgcttttatcctcattactttgagagccatcaccagcgactatgtcgtatgggtaaagcgcttatttatcggaagaaatccgataaataagaagcatcaaag

SEQ ID NO: 1345 - DNA, 108 bp, Artificial Sequence
  scaffold variant
tactggcgcttttatctcattactttgagagccatcaccagcgactatgtcgtatgggtaaagcgcttatttatcggagagaaatctgataaataagaagcatcaaag

SEQ ID NO: 1346 - DNA, 109 bp, Artificial Sequence; identical to SEQ ID NO: 1228
  scaffold variant

SEQ ID NO: 1347 - DNA, 110 bp, Artificial Sequence
  scaffold variant
tactggcgcttttatcgtcattactttgagagccatcaccagcgactatgtcgtatgggtaaagcgcttatttatccggagagaaatccgataaataagaagcatcaaag

SEQ ID NO: 1348 - DNA, 108 bp, Artificial Sequence
  scaffold variant
tactggcgcttttatcctcattactttgagagccatcaccagcgactatgtcgtatgggtaaagcgcttatttatcgcgagaaatccgataaataagaagcatcaaag

SEQ ID NO: 1349 - DNA, 110 bp, Artificial Sequence
  scaffold variant
tactggcgcttttaatctcattactttgagagccatcaccagcgactatgtcgtatgggtaaagcgcttatttatccggagagaaatccgataaataagaagcatcaaag

SEQ ID NO: 1350 - DNA, 107 bp, Artificial Sequence; identical to SEQ ID NO: 1263
  scaffold variant

SEQ ID NO: 1351 - DNA, 108 bp, Artificial Sequence
  scaffold variant
tactggcgcttttatctcattactttgagagccatcaccagcgactatgtcgtatgggtaaagcggtatttatcggagagaaatcgcgataaataagaagcatcaaag

SEQ ID NO: 1352 - DNA, 108 bp, Artificial Sequence; identical to SEQ ID NO: 487
  scaffold variant

SEQ ID NO: 1353 - DNA, 108 bp, Artificial Sequence
  scaffold variant
tactggcgcttttatcatcattactttgagagccatcaccagcgactatgtcgtatgggtaaagcgcttatttatcaagagaaatccgataaataagaagcatcaaag

SEQ ID NO: 1354 - DNA, 107 bp, Artificial Sequence; identical to SEQ ID NO: 970
  scaffold variant

SEQ ID NO: 1355 - DNA, 109 bp, Artificial Sequence; identical to SEQ ID NO: 1190
  scaffold variant

SEQ ID NO: 1356 - DNA, 107 bp, Artificial Sequence; identical to SEQ ID NO: 960
  scaffold variant

SEQ ID NO: 1357 - DNA, 108 bp, Artificial Sequence
  scaffold variant
tacggcgcttttatctcattactttgagagccatcaccagcgactatgtcgtatgggtaaagcgcttatttatcggagagaatatccgataaataagaagcatcaaag

SEQ ID NO: 1358 - DNA, 110 bp, Artificial Sequence
  scaffold variant
tactggcgcttttatctctattactttgagagccatcaccagcgactatgtcgtatgggtaaagcgcttattctatcggagagaaatccgataaataagaagcatcaaag

SEQ ID NO: 1359 - DNA, 110 bp, Artificial Sequence
  scaffold variant
tactggcgcttttatctcattactttgagagccatcaccagcgactatgtcgtatgggtaaagcgcttatttattcggagagaaatcgcgataaataagaagcatcaaag

SEQ ID NO: 1360 - DNA, 107 bp, Artificial Sequence; identical to SEQ ID NO: 960
  scaffold variant

SEQ ID NO: 1361 - DNA, 106 bp, Artificial Sequence
  scaffold variant
ctggcgcttttatctcattactttgagagccatcaccagcgactatgtcgtatgggtaaagcgcttatttagcggagagaaatccgataaataagaagcatcaaag

SEQ ID NO: 1362 - DNA, 107 bp, Artificial Sequence; identical to SEQ ID NO: 1307
  scaffold variant

SEQ ID NO: 1363 - DNA, 106 bp, Artificial Sequence
  scaffold variant
tctggcgcttttatctcattactttgagagccatcaccagcgactatgtcgtatgggtaaagctttatttatcggagagaaatccgataaataagaagcatcaaag

SEQ ID NO: 1364 - DNA, 108 bp, Artificial Sequence
  scaffold variant
ctactggcgcttttatctcattactttgagagccatcaccagcgactatgtcgtatgggtaaagcgcttatttacggagagaaatccgataaataagaagcatcaaag

SEQ ID NO: 1365 - DNA, 110 bp, Artificial Sequence
  scaffold variant
tactggcgcttttatctgcattactttgagagccatcaccagcgactatgtcgtatgggtaaagcgcttatttatcggagagaaatgccgataaataagaagcatcaaag

SEQ ID NO: 1366 - DNA, 110 bp, Artificial Sequence
  scaffold variant
tactggcgcttttatcctcattactttgagagccatcaccagcgactatgtcgtatgggtaaagcgcttatttatccggagagaaatccgataaataagaagcatcaaag

SEQ ID NO: 1367 - DNA, 110 bp, Artificial Sequence
  scaffold variant
tactggcgcttttatcttcattactttgagagccatcaccagcgactatgtcgtatgggtaaagcgcttatttatcggagagaaatccgcataaataagaagcatcaaag

SEQ ID NO: 1368 - DNA, 109 bp, Artificial Sequence; identical to SEQ ID NO: 1228
  scaffold variant

SEQ ID NO: 1369 - DNA, 108 bp, Artificial Sequence
  scaffold variant
tctggcgcttttatctgcattactttgagagccatcaccagcgactatgtcgtatgggtaaagcgcttatttatcggagagaaatccgataaataagaagcatcaaag

SEQ ID NO: 1370 - DNA, 110 bp, Artificial Sequence
  scaffold variant
tactggcgcttttatctcattactttgagagccatcaccagcgactatgtcgtatgggtaaagcgcttatttatccggagagaaatccgataaataagaaagcatcaaag

SEQ ID NO: 1371 - DNA, 110 bp, Artificial Sequence
  scaffold variant
ctactggcgcttttatctcattactttgagagccatcaccagcgactatgtcgtatgggtaaagcgcttatttatcggagagaaatcctgataaataagaagcatcaaag

SEQ ID NO: 1372 - DNA, 107 bp, Artificial Sequence
  scaffold variant
tactggcgcttttatactcattactttgagagccatcaccagcgactatgtcgtatgggtaaagcgcttatttatcggagaaatccgataaataagaagcatcaaag

SEQ ID NO: 1373 - DNA, 110 bp, Artificial Sequence
  scaffold variant
tactggcgcttttatctcattactttcgagagccatcaccagcgactatgtcgtatgggtaaagcgcttatttatcggagagataatccgataaataagaagcatcaaag

SEQ ID NO: 1374 - DNA, 110 bp, Artificial Sequence
  scaffold variant
ctactggcgcttttatctcattactttgagagccatcaccagcgactatgtcgtatgggtaaagcgcttatttatccggagagaaatccgataaataagaagcatcaaag

SEQ ID NO: 1375 - DNA, 108 bp, Artificial Sequence
  scaffold variant
tactggcgcttttatctgcattactttgagagccatcaccagcgactatgtcgtatgggtaaagcgcttatttatcgagagaaatccgataaataagaagcatcaaag

SEQ ID NO: 1376 - DNA, 107 bp, Artificial Sequence
  scaffold variant
cctggcgcttttatctcattactttgagagccatcaccagcgactatgtcgtatgggtaaagcgcttatttatcggagagaaatccgctaaataagaagcatcaaag

SEQ ID NO: 1377 - DNA, 106 bp, Artificial Sequence; identical to SEQ ID NO: 504
  scaffold variant

SEQ ID NO: 1378 - DNA, 110 bp, Artificial Sequence
  scaffold variant
tactggcgcttttatctcattactttgagagccatcaccagcgactatgtcgtatgggtaaagcgcttatttagtcggagagaaatcgcgataaataagaagcatcaaag

SEQ ID NO: 1379 - DNA, 108 bp, Artificial Sequence
  scaffold variant
tactggcgcttttatcttcattactttgagagccatcaccagcgactatgtcgtatgggtaaagcgcttatttatcggaagaaatccgataaataagaagcatcaaag

SEQ ID NO: 1380 - DNA, 107 bp, Artificial Sequence; identical to SEQ ID NO: 960
  scaffold variant

SEQ ID NO: 1381 - DNA, 107 bp, Artificial Sequence; identical to SEQ ID NO: 878
  scaffold variant

SEQ ID NO: 1382 - DNA, 107 bp, Artificial Sequence
  scaffold variant
tactggcgcttttatctcattactttgagagccatcaccagcgactatgtcgtatgggtaaagcgcttatttacggagagaaatccgataaataagaagcatcaaag

SEQ ID NO: 1383 - DNA, 109 bp, Artificial Sequence; identical to SEQ ID NO: 957
  scaffold variant

SEQ ID NO: 1384 - DNA, 110 bp, Artificial Sequence
  scaffold variant
tactggcgcttttatcctcattactttgagagccatcaccagcgactatgtcgtatgggtaaagcgcttatttatcggagagaaatccgcataaataagaagcatcaaag

SEQ ID NO: 1385 - DNA, 109 bp, Artificial Sequence; identical to SEQ ID NO: 785
  scaffold variant

SEQ ID NO: 1386 - DNA, 110 bp, Artificial Sequence
  scaffold variant
tactggcgcttttattctcattactttgagagccatcaccagcgactatgtcgtatgggtaaagcgcttatttatcggagagaaatccgaataaataagaagcatcaaag

SEQ ID NO: 1387 - DNA, 108 bp, Artificial Sequence
  scaffold variant
cctggcgcttttatctcattactttgagagccatcaccagcgactatgtcgtatgggtaaagcgcttatttatcggagagagaatccgataaataagaagcatcaaag

SEQ ID NO: 1388 - DNA, 107 bp, Artificial Sequence
  scaffold variant
tctggcgcttttatctcattactttgagagccatcaccagcgactatgtcgtatgggtaaagcgcttatttatcggggagaaatccgataaataagaagcatcaaag

SEQ ID NO: 1389 - DNA, 108 bp, Artificial Sequence
  scaffold variant
tctggcgcttttatctcattactttgagagccatcaccagcgactatgtcgtatgggtaaagcgcttatttatcgcgagagaaatccgataaataagaagcatcaaag

SEQ ID NO: 1390 - DNA, 107 bp, Artificial Sequence
  scaffold variant
ctggcgcttttatctcattactttgagagccatcaccagcgactatgtcgtatgggtaaagcgcttattttatcggagagaaatccgataaataagaagcatcaaag

SEQ ID NO: 1391 - DNA, 110 bp, Artificial Sequence
  scaffold variant
tactggcgcttttatctcattactttgagagccatcaccagcgactatgtcgtatgggtaaagcgcttatttatccggagagaaatcacgataaataagaagcatcaaag

SEQ ID NO: 1392 - DNA, 109 bp, Artificial Sequence; identical to SEQ ID NO: 882
  scaffold variant

SEQ ID NO: 1393 - DNA, 108 bp, Artificial Sequence
  scaffold variant
tactggcgcttttatctcattactttgagagccatcaccagcgactatgtcgtattgggtaaagcgcttatttatcggaggaaatccgataaataagaagcatcaaag

SEQ ID NO: 1394 - DNA, 104 bp, Artificial Sequence
  scaffold variant
tggcgcttttatctcattactttgagagccatcaccagcgactatgtcgtatgggtaaagcgcttatttatcggaagaaatccgataaataagaagcatcaaag

SEQ ID NO: 1395 - DNA, 109 bp, Artificial Sequence; identical to SEQ ID NO: 986
  scaffold variant

SEQ ID NO: 1396 - DNA, 106 bp, Artificial Sequence; identical to SEQ ID NO: 430
  scaffold variant

SEQ ID NO: 1397 - DNA, 106 bp, Artificial Sequence
  scaffold variant
actggcgcttttatctcattactttgagagccatcaccagcgactatgtcgtatgggtaaagcgcttatttatggagagaaatccgataaataagaagcatcaaag

SEQ ID NO: 1398 - DNA, 105 bp, Artificial Sequence; identical to SEQ ID NO: 473
  scaffold variant

SEQ ID NO: 1399 - DNA, 106 bp, Artificial Sequence
  scaffold variant
tactggcgcttttatctcattactttgagagccatcaccagcgactatgtcgtatgggtaaagcgcttatttatcggagatatccgataaataagaagcatcaaag

SEQ ID NO: 1400 - DNA, 107 bp, Artificial Sequence; identical to SEQ ID NO: 1081
  scaffold variant

SEQ ID NO: 1401 - DNA, 107 bp, Artificial Sequence
  scaffold variant
tactggcgcttttatctcattactttgagagccatcaccagcgactatgtcgtatgggtaaagcgcttatttatttagagaaatccgataaataagaagcatcaaag

SEQ ID NO: 1402 - DNA, 106 bp, Artificial Sequence
  scaffold variant
tacggcgcttttatctcattactttgagagccatcaccagcgactatgtcgtatgggtaaagcgcttatttccggagagaaatccgataaataagaagcatcaaag

SEQ ID NO: 1403 - DNA, 110 bp, Artificial Sequence
  scaffold variant
tactggcgcttttatctcgattactttgagagccatcaccagcgactatgtcgtatgggtaaagcgcttattctatcggagagaaatccgataaataagaagcatcaaag

SEQ ID NO: 1404 - DNA, 105 bp, Artificial Sequence
  scaffold variant
ctggcgcttttatctcattactttgagagccatcaccagcgactatgtcgtatgggtaaagcgcttatttatagagagaaatccgataaataagaagcatcaaag

SEQ ID NO: 1405 - DNA, 108 bp, Artificial Sequence
  scaffold variant
tactggcgcttttatctcattactttgagagccatcaccagcgactatgtcgtatgggtaaagcgcttatttattcggagagaaatcgataaataagaagcatcaaag

SEQ ID NO: 1406 - DNA, 109 bp, Artificial Sequence; identical to SEQ ID NO: 1055
  scaffold variant

SEQ ID NO: 1407 - DNA, 106 bp, Artificial Sequence
  scaffold variant
gctggcgcttttatctcattactttgagagccatcaccagcgactatgtcgtatgggtaaagcgcttatttatcggcagaaatccgataaataagaagcatcaaag

SEQ ID NO: 1408 - DNA, 108 bp, Artificial Sequence; identical to SEQ ID NO: 618
  scaffold variant

SEQ ID NO: 1409 - DNA, 107 bp, Artificial Sequence; identical to SEQ ID NO: 560
  scaffold variant

SEQ ID NO: 1410 - DNA, 108 bp, Artificial Sequence
  scaffold variant
tactggcgcttttatctcattactttgagagccatcaccagcgactatgtcgtatgggtaaagcgcttatttatcggagagaaatccgataaataagaagcatcaaag

SEQ ID NO: 1411 - DNA, 107 bp, Artificial Sequence; identical to SEQ ID NO: 878
  scaffold variant

SEQ ID NO: 1412 - DNA, 106 bp, Artificial Sequence; identical to SEQ ID NO: 1340
  scaffold variant

SEQ ID NO: 1413 - DNA, 106 bp, Artificial Sequence
  scaffold variant
ctggcgcttttatctcattactttgagagccatcaccagcgactatgtcgtatgggtaaagcgcttatttatcggagagaaatccggtaaataagaagcatcaaag

SEQ ID NO: 1414 - DNA, 107 bp, Artificial Sequence
  scaffold variant
gctggcgcttttatctcattactttgagagccatcaccagcgactatgtcgtatgggtaaagcgcttatttctcggagagaaatccgataaataagaagcatcaaag

SEQ ID NO: 1415 - DNA, 106 bp, Artificial Sequence
  scaffold variant
actggcgcttttatctcattactttgagagccatcaccagcgactatgtcgtatgggtaaagcgcttatttatagagagaaatccgataaataagaagcatcaaag

SEQ ID NO: 1416 - DNA, 105 bp, Artificial Sequence
  scaffold variant
tcggcgcttttatctcattactttgagagccatcaccagcgactatgtcgtatgggtaaagcgcttatttatccagagaaatccgataaataagaagcatcaaag

SEQ ID NO: 1417 - DNA, 107 bp, Artificial Sequence; identical to SEQ ID NO: 1307
  scaffold variant

SEQ ID NO: 1418 - DNA, 108 bp, Artificial Sequence
  scaffold variant
tactggcgcttttatcttcattactttgagagccatcaccagcgactatgtcgtatgggtaaagcgcttatttccggagagaaatccgataaataagaagcatcaaag

SEQ ID NO: 1419 - DNA, 109 bp, Artificial Sequence
  scaffold variant
tactggcgcttttattctcattactttgagagccatcaccagcgactatgtcgtatgggtaaagcgcttatttatcggggagaaatccgataaataagaagcatcaaag

SEQ ID NO: 1420 - DNA, 106 bp, Artificial Sequence
  scaffold variant
cctggcgcttttatctcattactttgagagccatcaccagcgactatgtcgtatgggtaaagcgatatttatcggagagaaatccgataaataagaagcatcaaag

SEQ ID NO: 1421 - DNA, 105 bp, Artificial Sequence; identical to SEQ ID NO: 653
  scaffold variant

SEQ ID NO: 1422 - DNA, 108 bp, Artificial Sequence
  scaffold variant
tacggcgcttttatctcattactttgagagccatcaccagcgactatgtcgtatgggtaaagcgcttatttatcggagagaaatccgattaaataagaagcatcaaag

SEQ ID NO: 1423 - DNA, 107 bp, Artificial Sequence; identical to SEQ ID NO: 1382
  scaffold variant

SEQ ID NO: 1424 - DNA, 110 bp, Artificial Sequence
  scaffold variant
tactggcgcttttaatctcattactttgagagccatcaccagcgactatgtcgtagtgggtaaagcgcttatttatcggagagaaatccgataaataagaagcatcaaag

SEQ ID NO: 1425 - DNA, 106 bp, Artificial Sequence
  scaffold variant
tacggcgcttttatctcattactttgagagccatcaccagcgactatgtcgtatgggtaaagcgcttatttatcggagagaatccgataaataagaagcatcaaag

SEQ ID NO: 1426 - DNA, 108 bp, Artificial Sequence
  scaffold variant
actggcgcttttatctcattactttgagagccatcaccagcgactatgtcgtatgggtaaagcgcttatttatcggagagagaatccgataaataagaagcatcaaag

SEQ ID NO: 1427 - DNA, 110 bp, Artificial Sequence
  scaffold variant
tactggcgcttttatcctcattactttgagagccatcaccagcgactatgtcgtatgggtaaagcgcttattttatcggagagaaatccgataaataagaagcatcaaag

SEQ ID NO: 1428 - DNA, 108 bp, Artificial Sequence
  scaffold variant
cctggcgcttttatctcattactttgagagccatcaccagcgactatgtcgtatgggtaaagcgcttatcttatcggagagaaatccgataaataagaagcatcaaag

SEQ ID NO: 1429 - DNA, 108 bp, Artificial Sequence
  scaffold variant
tactggcgcttttatctgcattactttgagagccatcaccagcgactatgtcgtatgggtaaagcgcttatttatcggagagcatccgataaataagaagcatcaaag

SEQ ID NO: 1430 - DNA, 109 bp, Artificial Sequence; identical to SEQ ID NO: 785
  scaffold variant

SEQ ID NO: 1431 - DNA, 108 bp, Artificial Sequence
  scaffold variant
gctggcgcttttatctgcattactttgagagccatcaccagcgactatgtcgtatgggtaaagcgcttatttatcggagagaaatccgataaataagaagcatcaaag

SEQ ID NO: 1432 - DNA, 109 bp, Artificial Sequence
  scaffold variant
tactggcgcttttatctcattactttgagagccatcaccagcgactatgtcgtatgggtaaagcgcttatttatcggagagaaatccgtataaataagaagcatcaaag

SEQ ID NO: 1433 - DNA, 107 bp, Artificial Sequence
  scaffold variant
ctggcgcttttatctcattactttgagagccatcaccagcgactatgtcgtatgggtaaagcgcttatttatcggagagataatccgataaataagaagcatcaaag

SEQ ID NO: 1434 - DNA, 108 bp, Artificial Sequence
  scaffold variant
tactggcgcttttattcattactttgagagccatcaccagcgactatgtcgtatgggtaaagcgcttatttatcgggagagaaatccgataaataagaagcatcaaag

SEQ ID NO: 1435 - DNA, 105 bp, Artificial Sequence; identical to SEQ ID NO: 569
  scaffold variant

SEQ ID NO: 1436 - DNA, 108 bp, Artificial Sequence
  scaffold variant
tactggcgcttttatctcgattactttgagagccatcaccagcgactatgtcgtatgggtaaagcgcttatttatcgggagaaatccgataaataagaagcatcaaag

SEQ ID NO: 1437 - DNA, 107 bp, Artificial Sequence; identical to SEQ ID NO: 1081
  scaffold variant

SEQ ID NO: 1438 - DNA, 105 bp, Artificial Sequence
  scaffold variant
atggcgcttttatctcattactttgagagccatcaccagcgactatgtcgtatgggtaaagcgcttatttatcggagagagtccgataaataagaagcatcaaag

SEQ ID NO: 1439 - DNA, 108 bp, Artificial Sequence
  scaffold variant
tctggcgcttttatctcattactttgagagccatcaccagcgactatgtcgtatgggtaaagcgcttatttatcggagagaaatccgataaataagtaagcatcaaag

SEQ ID NO: 1440 - DNA, 108 bp, Artificial Sequence
  scaffold variant
tactggcgcttttatctcattactttgagagccatcaccagcgactatgtcgtatgggtaaagcgcttatttatgcggagagaatccgataaataagaagcatcaaag

SEQ ID NO: 1441 - DNA, 107 bp, Artificial Sequence
  scaffold variant
actggcgcttttatctcattactttgagagccatcaccagcgactatgtcgtatgggtaaagcgcttatttatcggagagaaatccggtaaataagaagcatcaaag

SEQ ID NO: 1442 - DNA, 106 bp, Artificial Sequence
  scaffold variant
tacggcgcttttatctcattactttgagagccatcaccagcgactatgtcgtatgggtaaagcgcttatttatagagagaaatccgataaataagaagcatcaaag

SEQ ID NO: 1443 - DNA, 110 bp, Artificial Sequence
  scaffold variant
tactggcgcttttatcctcattactttgagagccatcaccagcgactatgtcgtatgggtaaagcgcttatttatcggagagaaaatccgataaataagaagcatcaaag

SEQ ID NO: 1444 - DNA, 109 bp, Artificial Sequence; identical to SEQ ID NO: 1025
  scaffold variant

SEQ ID NO: 1445 - DNA, 110 bp, Artificial Sequence
  scaffold variant
tactggcgcttttatcatcattactttgagagccatcaccagcgactatgtcgtatgggtaaagcgcttatttagtcggagagaaatccgataaataagaagcatcaaag

SEQ ID NO: 1446 - DNA, 107 bp, Artificial Sequence; identical to SEQ ID NO: 1263
  scaffold variant

SEQ ID NO: 1447 - DNA, 105 bp, Artificial Sequence; identical to SEQ ID NO: 453
  scaffold variant

SEQ ID NO: 1448 - DNA, 107 bp, Artificial Sequence
  scaffold variant
tacggcgcttttatctcattactttgagagccatcaccagcgactatgtcgtatgggtaaagcgcttatttctcggagagaaatccgataaataagaagcatcaaag

SEQ ID NO: 1449 - DNA, 105 bp, Artificial Sequence; identical to SEQ ID NO: 523
  scaffold variant

SEQ ID NO: 1450 - DNA, 109 bp, Artificial Sequence; identical to SEQ ID NO: 957
  scaffold variant

SEQ ID NO: 1451 - DNA, 109 bp, Artificial Sequence; identical to SEQ ID NO: 1228
  scaffold variant

SEQ ID NO: 1452 - DNA, 108 bp, Artificial Sequence
  scaffold variant
tactggcgcttttatcctcattactttgagagccatcaccagcgactatgtcgtatgggtaaagcgcttatttgcggagagaaatccgataaataagaagcatcaaag

SEQ ID NO: 1453 - DNA, 107 bp, Artificial Sequence
  scaffold variant
ctggcgcttttatctcattactttgagagccatcaccagcgactatgtcgtatgggtaaagcgcttatttatcggagagaaatccgataaataagtaagcatcaaag

SEQ ID NO: 1454 - DNA, 108 bp, Artificial Sequence
  scaffold variant
tactggcgcttttatcctcattactttgagagccatcaccagcgactatgtcgtatgggtaaagcgcttatttatcggagagtatccgataaataagaagcatcaaag

SEQ ID NO: 1455 - DNA, 110 bp, Artificial Sequence
  scaffold variant
tactggcgcttttatctcattactttagagagccatcaccagcgactatgtcgtatgggtaaagcgcttatttaatcggagagaaatccgataaataagaagcatcaaag

SEQ ID NO: 1456 - DNA, 108 bp, Artificial Sequence
  scaffold variant
tctggcgcttttatctctattactttgagagccatcaccagcgactatgtcgtatgggtaaagcgcttatttatcggagagaaatccgataaataagaagcatcaaag

SEQ ID NO: 1457 - DNA, 108 bp, Artificial Sequence
  scaffold variant
actggcgcttttatctcattactttgagagccatcaccagcgactatgtcgtatgggtaaagcgcttatttatcggagagaaatccgataaataagaaagcatcaaag

SEQ ID NO: 1458 - DNA, 108 bp, Artificial Sequence
  scaffold variant
tactggcgcttttatcttcattactttgagagccatcaccagcgactatgtcgtatgggtaaagcggtatttatcggagagaaatccgataaataagaagcatcaaag

SEQ ID NO: 1459 - DNA, 109 bp, Artificial Sequence; identical to SEQ ID NO: 1055
  scaffold variant

SEQ ID NO: 1460 - DNA, 105 bp, Artificial Sequence
  scaffold variant
ctggcgcttttatctcattactttgagagccatcaccagcgactatgtcgtatgggtaaagcgcttatttatcggagtaaatccgataaataagaagcatcaaag

SEQ ID NO: 1461 - DNA, 108 bp, Artificial Sequence
  scaffold variant
tactggcgcttttattctcattactttgagagccatcaccagcgactatgtcgtatgggtaaagcgcttatttatcggagagaatccgataaataagaagcatcaaag

SEQ ID NO: 1462 - DNA, 109 bp, Artificial Sequence; identical to SEQ ID NO: 957
  scaffold variant

SEQ ID NO: 1463 - DNA, 106 bp, Artificial Sequence
  scaffold variant
tctggcgcttttatctcattactttgagagccatcaccagcgactatgtcgtatgggtaaagcgcttatttgcggagagaaatccgataaataagaagcatcaaag

SEQ ID NO: 1464 - DNA, 110 bp, Artificial Sequence
  scaffold variant
tactggcgcttttatcctcattactttgagagccatcaccagcgactatgtcgtatgggtaaagcgcttatttatcggagagaaatcccgataaataagaagcatcaaag

SEQ ID NO: 1465 - DNA, 106 bp, Artificial Sequence
  scaffold variant
actggcgcttttatctcattactttgagagccatcaccagcgactatgtcgtatgggtaaagcgcttatttatcggagagaaattgataaataagaagcatcaaag

SEQ ID NO: 1466 - DNA, 106 bp, Artificial Sequence
  scaffold variant
tactggcgcttttatctcattactttgagagccatcaccagcgactatgtcgtatgggtaaagcgcttatttatcggggaaatccgataaataagaagcatcaaag

SEQ ID NO: 1467 - DNA, 106 bp, Artificial Sequence
  scaffold variant
ctggcgcttttatctcattactttgagagccatcaccagcgactatgtcgtatgggtaaagcgcttatttctcggagagaaatccgataaataagaagcatcaaag

SEQ ID NO: 1468 - DNA, 110 bp, Artificial Sequence; identical to SEQ ID NO: 684
  scaffold variant

SEQ ID NO: 1469 - DNA, 107 bp, Artificial Sequence; identical to SEQ ID NO: 1142
  scaffold variant

SEQ ID NO: 1470 - DNA, 108 bp, Artificial Sequence
  scaffold variant
ctactggcgcttttatctcattactttgagagccatcaccagcgactatgtcgtatgggtaaagcgcttatttatcggagacaatccgataaataagaagcatcaaag

SEQ ID NO: 1471 - DNA, 107 bp, Artificial Sequence
  scaffold variant
tactggcgcttttatctcattactttgagagccatcaccagcgactatgtcgtatgggtaaagcgcttatttatcggagataatccgataaataagaagcatcaaag

SEQ ID NO: 1472 - DNA, 110 bp, Artificial Sequence
  scaffold variant
tactggcgcttttatcgtcattactttgagagccatcaccagcgactatgtcgtatgggtaaagcgcttatttatcggcagagaaatccgataaataagaagcatcaaag

SEQ ID NO: 1473 - DNA, 108 bp, Artificial Sequence
  scaffold variant
tactggcgcttttatctcattactttgagagccatcaccagcgactatgtcgtatgggtaaagcgcttatttatcggtgagaaatccgataaataagaagcatcaaag

SEQ ID NO: 1474 - DNA, 108 bp, Artificial Sequence
  scaffold variant
actggcgcttttatctcattactttgagagccatcaccagcgactatgtcgtatgggtaaagcgcttattttatcggagagaaatccgataaataagaagcatcaaag

SEQ ID NO: 1475 - DNA, 108 bp, Artificial Sequence
  scaffold variant
tactggcgcttttatctgcattactttgagagccatcaccagcgactatgtcgtatgggtaaagcgcttatttattgagagaaatccgataaataagaagcatcaaag

SEQ ID NO: 1476 - DNA, 107 bp, Artificial Sequence; identical to SEQ ID NO: 878
  scaffold variant

SEQ ID NO: 1477 - DNA, 109 bp, Artificial Sequence; identical to SEQ ID NO: 1228
  scaffold variant

SEQ ID NO: 1478 - DNA, 105 bp, Artificial Sequence; identical to SEQ ID NO: 473
  scaffold variant

SEQ ID NO: 1479 - DNA, 107 bp, Artificial Sequence; identical to SEQ ID NO: 1035
  scaffold variant

SEQ ID NO: 1480 - DNA, 108 bp, Artificial Sequence
  scaffold variant
tactggcgcttttatctgcattactttgagagccatcaccagcgactatgtcgtatgggtaaagctttatttatcggagagaaatccgataaataagaagcatcaaag

SEQ ID NO: 1481 - DNA, 108 bp, Artificial Sequence
  scaffold variant
cctggcgcttttatctcattactttgagagccatcaccagcgactatgtcgtatgggtaaagcgcttatttatcggagagaaatccggataaataagaagcatcaaag

SEQ ID NO: 1482 - DNA, 107 bp, Artificial Sequence; identical to SEQ ID NO: 1035
  scaffold variant

SEQ ID NO: 1483 - DNA, 108 bp, Artificial Sequence
  scaffold variant
tacggcgcttttatctcattactttgagagccatcaccagcgactatgtcgtatgggtaaagcgcttatttatcggagagaacatccgataaataagaagcatcaaag

SEQ ID NO: 1484 - DNA, 108 bp, Artificial Sequence
  scaffold variant
tctggcgcttttatctcattactttgagagccatcaccagcgactatgtcgtatgggtaaagcgcttatttatcggagagaaatccggataaataagaagcatcaaag

SEQ ID NO: 1485 - DNA, 106 bp, Artificial Sequence
  scaffold variant
taaggcgcttttatctcattactttgagagccatcaccagcgactatgtcgtatgggtaaagcgcttatttatcaagagaaatccgataaataagaagcatcaaag

SEQ ID NO: 1486 - DNA, 108 bp, Artificial Sequence
  scaffold variant
tactggcgcttttatcctcattactttgagagccatcaccagcgactatgtcgtatgggtaaagcgcttatttatcggagacaatccgataaataagaagcatcaaag

SEQ ID NO: 1487 - DNA, 107 bp, Artificial Sequence; identical to SEQ ID NO: 1307
  scaffold variant

SEQ ID NO: 1488 - DNA, 108 bp, Artificial Sequence
  scaffold variant
cctggcgcttttatctcattactttgagagccatcaccagcgactatgtcgtatgggtaaagcgcttatttatcggagagaaatccgataaataagaaagcatcaaag

SEQ ID NO: 1489 - DNA, 105 bp, Artificial Sequence
  scaffold variant
actggcgcttttatctcattactttgagagccatcaccagcgactatgtcgtatgggtaaagcgcttatttatcggtgaaatccgataaataagaagcatcaaag

SEQ ID NO: 1490 - DNA, 109 bp, Artificial Sequence; identical to SEQ ID NO: 1025
  scaffold variant

SEQ ID NO: 1491 - DNA, 109 bp, Artificial Sequence; identical to SEQ ID NO: 563
  scaffold variant

SEQ ID NO: 1492 - DNA, 106 bp, Artificial Sequence
  scaffold variant
tctggcgcttttatctcattactttgagagccatcaccagcgactatgtcgtatgggtaaagcgatatttatcggagagaaatccgataaataagaagcatcaaag

SEQ ID NO: 1493 - DNA, 107 bp, Artificial Sequence
  scaffold variant
ctggcgcttttatctctattactttgagagccatcaccagcgactatgtcgtatgggtaaagcgcttatttatcggagagaaatccgataaataagaagcatcaaag

SEQ ID NO: 1494 - DNA, 110 bp, Artificial Sequence
  scaffold variant
tactggcgcttttatcttcattactttgagagccatcaccagcgactatgtcgtatgggtaaagcgcttattgtatcggagagaaatccgataaataagaagcatcaaag

SEQ ID NO: 1495 - DNA, 107 bp, Artificial Sequence
  scaffold variant
cctggcgcttttatctcattactttgagagccatcaccagcgactatgtcgtatgggtaaagcgcttatttatcggagagaaatccgatatataagaagcatcaaag

SEQ ID NO: 1496 - DNA, 106 bp, Artificial Sequence
  scaffold variant
gatggcgcttttatctcattactttgagagccatcaccagcgactatgtcgtatgggtaaagcgcttatttatggagagaaatccgataaataagaagcatcaaag

SEQ ID NO: 1497 - DNA, 110 bp, Artificial Sequence
  scaffold variant
tactggcgcttttatactcattactttgagagccatcaccagcgactatgtcgtatgggtaaagcgcttatttatccggagagaaatccgataaataagaagcatcaaag

SEQ ID NO: 1498 - DNA, 108 bp, Artificial Sequence
  scaffold variant
cctggcgcttttatctcattactttgagagccatcaccagcgactatgtcgtatgggtaaagcgcttatttatcggagagataatccgataaataagaagcatcaaag

SEQ ID NO: 1499 - DNA, 108 bp, Artificial Sequence
  scaffold variant
tactggcgcttttatcctcattactttgagagccatcaccagcgactatgtcgtatgggtaaagcgcttatttatcggagagaaatccgtaaataagaagcatcaaag

SEQ ID NO: 1500 - DNA, 108 bp, Artificial Sequence
  scaffold variant
tactggcgcttttatctctattactttgagagccatcaccagcgactatgtcgtatgggtaaagcgcttatttatcggagagaaatccgaaaataagaagcatcaaag

SEQ ID NO: 1501 - DNA, 105 bp, Artificial Sequence
  scaffold variant
ctggcgcttttatctcattactttgagagccatcaccagcgactatgtcgtatgggtaaagcgcttatttatcggagagaaatccggaaataagaagcatcaaag

SEQ ID NO: 1502 - DNA, 106 bp, Artificial Sequence
  scaffold variant
ctggcgcttttatctcattactttgagagccatcaccagcgactatgtcgtatgggtaaagcgcttatttatcggggagaaatccgataaataagaagcatcaaag

SEQ ID NO: 1503 - DNA, 106 bp, Artificial Sequence; identical to SEQ ID NO: 504
  scaffold variant

SEQ ID NO: 1504 - DNA, 107 bp, Artificial Sequence; identical to SEQ ID NO: 878
  scaffold variant

SEQ ID NO: 1505 - DNA, 107 bp, Artificial Sequence; identical to SEQ ID NO: 1035
  scaffold variant

SEQ ID NO: 1506 - DNA, 110 bp, Artificial Sequence
  scaffold variant
ctactggcgcttttatctcattactttgagagccatcaccagcgactatgtcgtatgggtaaagcgcttatttatcggagagaaatctcgataaataagaagcatcaaag

SEQ ID NO: 1507 - DNA, 105 bp, Artificial Sequence; identical to SEQ ID NO: 925
  scaffold variant

SEQ ID NO: 1508 - DNA, 107 bp, Artificial Sequence
  scaffold variant
ctggcgcttttatctcattactttgagagccatcaccagcgactatgtcgtatgggtaaagcgcttatttatcggagagacaatccgataaataagaagcatcaaag

SEQ ID NO: 1509 - DNA, 107 bp, Artificial Sequence
  scaffold variant
tactggcgcttttatctcattactttgagagccatcaccagcgactatgtcgtatgggtaaagcgcttatttatcgtgagaaatccgataaataagaagcatcaaag

SEQ ID NO: 1510 - DNA, 106 bp, Artificial Sequence
  scaffold variant
actggcgcttttatctcattactttgagagccatcaccagcgactatgtcgtatgggtaaagcgcttatttatcggagagcatccgataaataagaagcatcaaag

SEQ ID NO: 1511 - DNA, 110 bp, Artificial Sequence
  scaffold variant
tactggcgcttttatcgtcattactttgagagccatcaccagcgactatgtcgtatgggtaaagcgcttatttatcggagagaaatcgcgataaataagaagcatcaaag

SEQ ID NO: 1512 - DNA, 103 bp, Artificial Sequence
  scaffold variant
ggcgcttttatctcattactttgagagccatcaccagcgactatgtcgtatgggtaaagcgcttatttatcgggagaaatccgataaataagaagcatcaaag

SEQ ID NO: 1513 - DNA, 110 bp, Artificial Sequence
  scaffold variant
tactggcgcttttatcctcattactttgagagccatcaccagcgactatgtcgtatgggtaaagcgcttatttatcggcagagaaatccgataaataagaagcatcaaag

SEQ ID NO: 1514 - DNA, 108 bp, Artificial Sequence
  scaffold variant
tactggcgcttttatctgcattactttgagagccatcaccagcgactatgtcgtatgggtaaagcgcttatttatcggagaggatccgataaataagaagcatcaaag

SEQ ID NO: 1515 - DNA, 107 bp, Artificial Sequence; identical to SEQ ID NO: 878
  scaffold variant

SEQ ID NO: 1516 - DNA, 109 bp, Artificial Sequence; identical to SEQ ID NO: 785
  scaffold variant

SEQ ID NO: 1517 - DNA, 104 bp, Artificial Sequence
  scaffold variant
ctggcgcttttatctcattactttgagagccatcaccagcgactatgtcgtatgggtaaagcgcttatttatcggagagaaccgataaataagaagcatcaaag

SEQ ID NO: 1518 - DNA, 110 bp, Artificial Sequence
  scaffold variant
ctactggcgcttttatctcattactttgagagccatcaccagcgactatgtcgtatgggtaaagcgcttatttatcggagagaaatcccgataaataagaagcatcaaag

SEQ ID NO: 1519 - DNA, 104 bp, Artificial Sequence; identical to SEQ ID NO: 654
  scaffold variant

SEQ ID NO: 1520 - DNA, 109 bp, Artificial Sequence; identical to SEQ ID NO: 563
  scaffold variant

SEQ ID NO: 1521 - DNA, 109 bp, Artificial Sequence; identical to SEQ ID NO: 1025
  scaffold variant

SEQ ID NO: 1522 - DNA, 105 bp, Artificial Sequence; identical to SEQ ID NO: 743
  scaffold variant

SEQ ID NO: 1523 - DNA, 104 bp, Artificial Sequence; identical to SEQ ID NO: 991
  scaffold variant

SEQ ID NO: 1524 - DNA, 109 bp, Artificial Sequence; identical to SEQ ID NO: 785
  scaffold variant

SEQ ID NO: 1525 - DNA, 110 bp, Artificial Sequence
  scaffold variant
taactggcgcttttatctcattactttgagagccatcaccagcgactatgtcgtatgggtaaagcgcttatttatcggagagaaatcccgataaataagaagcatcaaag

SEQ ID NO: 1526 - DNA, 108 bp, Artificial Sequence
  scaffold variant
ctactggcgcttttatctcattactttgagagccatcaccagcgactatgtcgtatgggtaaagcgcttatttatctagagaaatccgataaataagaagcatcaaag

SEQ ID NO: 1527 - DNA, 108 bp, Artificial Sequence
  scaffold variant
tactggcgcttttatctcattactttgagagccatcaccagcgactatgtcgtatgggtaaagcgcttatttagcggagagaaatccgataaataagaagcatcaaag

SEQ ID NO: 1528 - DNA, 108 bp, Artificial Sequence
  scaffold variant
actggcgcttttatctcattactttgagagccatcaccagcgactatgtcgtatgggtaaagcgcttatttcatcggagagaaatccgataaataagaagcatcaaag

SEQ ID NO: 1529 - DNA, 108 bp, Artificial Sequence; identical to SEQ ID NO: 487
  scaffold variant

SEQ ID NO: 1530 - DNA, 110 bp, Artificial Sequence
  scaffold variant
tactggcgcttttatctctattactttgagagccatcaccagcgactatgtcgtatgggtaaagcgcttatttatcgagagagaaatccgataaataagaagcatcaaag

SEQ ID NO: 1531 - DNA, 106 bp, Artificial Sequence; identical to SEQ ID NO: 570
  scaffold variant

SEQ ID NO: 1532 - DNA, 109 bp, Artificial Sequence; identical to SEQ ID NO: 785
  scaffold variant

SEQ ID NO: 1533 - DNA, 108 bp, Artificial Sequence
  scaffold variant
tactggcgcttttatctcattactttgagagccatcaccagcgactatgtcgtatgggtaaagcgcttatttttcggagagaaatccgataaataagaagcatcaaag

SEQ ID NO: 1534 - DNA, 104 bp, Artificial Sequence
  scaffold variant
tggcgcttttatctcattactttgagagccatcaccagcgactatgtcgtatgggtaaagcgcttattttcggagagaaatccgataaataagaagcatcaaag

SEQ ID NO: 1535 - DNA, 110 bp, Artificial Sequence
  scaffold variant
ttactggcgcttttatctcattactttgagagccatcaccagcgactatgtcgtatgggtaaagcgcttatttatacggagagaaatccgataaataagaagcatcaaag

SEQ ID NO: 1536 - DNA, 107 bp, Artificial Sequence
  scaffold variant
cctggcgcttttatctcattactttgagagccatcaccagcgactatgtcgtatgggtaaagcgcttatttatcggagagtaatccgataaataagaagcatcaaag

SEQ ID NO: 1537 - DNA, 108 bp, Artificial Sequence
  scaffold variant
tactggcgcttttatctattactttgagagccatcaccagcgactatgtcgtatgggtaaagcgcttatttatcgcgagagaaatccgataaataagaagcatcaaag

SEQ ID NO: 1538 - DNA, 107 bp, Artificial Sequence; identical to SEQ ID NO: 1017
  scaffold variant

SEQ ID NO: 1539 - DNA, 108 bp, Artificial Sequence
  scaffold variant
atactggcgcttttatctcattactttgagagccatcaccagcgactatgtcgtatgggtaaagcgcttatttattgagagaaatccgataaataagaagcatcaaag

SEQ ID NO: 1540 - DNA, 107 bp, Artificial Sequence; identical to SEQ ID NO: 1035
  scaffold variant

SEQ ID NO: 1541 - DNA, 105 bp, Artificial Sequence
  scaffold variant
actggcgcttttatctcattactttgagagccatcaccagcgactatgtcgtatgggtaaagcgcttatttatcggagagaaccgataaataagaagcatcaaag

SEQ ID NO: 1542 - DNA, 108 bp, Artificial Sequence
  scaffold variant
tactggcgcttttatctcattactttgagagccatcaccagcgactatgtcgtatgggtaaagcgcttatttatacggagagaaatcgataaataagaagcatcaaag

SEQ ID NO: 1543 - DNA, 107 bp, Artificial Sequence; identical to SEQ ID NO: 960
  scaffold variant

SEQ ID NO: 1544 - DNA, 107 bp, Artificial Sequence
  scaffold variant
tctggcgcttttatctcattactttgagagccatcaccagcgactatgtcgtatgggtaaagcgcttatttatcggagagaaatccgatgaataagaagcatcaaag

SEQ ID NO: 1545 - DNA, 108 bp, Artificial Sequence
  scaffold variant
tactggcgcttttatctcgattactttgagagccatcaccagcgactatgtcgtatgggtaaagcgcttatttattgagagaaatccgataaataagaagcatcaaag

SEQ ID NO: 1546 - DNA, 108 bp, Artificial Sequence
  scaffold variant
tactggcgcttttatcctcattactttgagagccatcaccagcgactatgtcgtatgggtaaagcgcttattttcggagagaaatccgataaataagaagcatcaaag

SEQ ID NO: 1547 - DNA, 107 bp, Artificial Sequence; identical to SEQ ID NO: 1382
  scaffold variant

SEQ ID NO: 1548 - DNA, 108 bp, Artificial Sequence
  scaffold variant
tacggcgcttttatctcattactttgagagccatcaccagcgactatgtcgtatgggtaaagcgcttatttatcggagagaaatccgataaataagagagcatcaaag

SEQ ID NO: 1549 - DNA, 109 bp, Artificial Sequence; identical to SEQ ID NO: 1093
  scaffold variant

SEQ ID NO: 1550 - DNA, 108 bp, Artificial Sequence
  scaffold variant
tactggcgcttttattctcattactttgagagccatcaccagcgactatgtcgtatgggtaaagcgcttatttatcggagagaaatccctaaataagaagcatcaaag

SEQ ID NO: 1551 - DNA, 108 bp, Artificial Sequence
  scaffold variant
ctactggcgcttttatctcattactttgagagccatcaccagcgactatgtcgtatgggtaaagcgcttatttatcggagataatccgataaataagaagcatcaaag

SEQ ID NO: 1552 - DNA, 108 bp, Artificial Sequence
  scaffold variant
actggcgcttttatctcattactttgagagccatcaccagcgactatgtcgtatgggtaaagcgcttatttatcggagagaaatccgataaataagtaagcatcaaag

SEQ ID NO: 1553 - DNA, 108 bp, Artificial Sequence
  scaffold variant
taactggcgcttttatctcattactttgagagccatcaccagcgactatgtcgtatgggtaaagcgcttatttatccagagaaatccgataaataagaagcatcaaag

SEQ ID NO: 1554 - DNA, 106 bp, Artificial Sequence
  scaffold variant
tctggcgcttttatctcattactttgagagccatcaccagcgactatgtcgtatgggtaaagcgcttatttatagagagaaatccgataaataagaagcatcaaag

SEQ ID NO: 1555 - DNA, 106 bp, Artificial Sequence
  scaffold variant
gctggcgcttttatctcattactttgagagccatcaccagcgactatgtcgtatgggtaaagcggtatttatcggagagaaatccgataaataagaagcatcaaag

SEQ ID NO: 1556 - DNA, 106 bp, Artificial Sequence
  scaffold variant
gctggcgcttttatctcattactttgagagccatcaccagcgactatgtcgtatgggtaaagcgcttatttatcggagagattccgataaataagaagcatcaaag

SEQ ID NO: 1557 - DNA, 108 bp, Artificial Sequence
  scaffold variant
ctactggcgcttttatctcattactttgagagccatcaccagcgactatgtcgtatgggtaaagcgcttatttatcaagagaaatccgataaataagaagcatcaaag

SEQ ID NO: 1558 - DNA, 109 bp, Artificial Sequence; identical to SEQ ID NO: 882
  scaffold variant

SEQ ID NO: 1559 - DNA, 107 bp, Artificial Sequence; identical to SEQ ID NO: 960
  scaffold variant

SEQ ID NO: 1560 - DNA, 107 bp, Artificial Sequence; identical to SEQ ID NO: 1307
  scaffold variant

SEQ ID NO: 1561 - DNA, 106 bp, Artificial Sequence
  scaffold variant
gctggcgcttttatctcattactttgagagccatcaccagcgactatgtcgtatgggtaaagcgcttatttatcggagagaaatcgataaataagaagcatcaaag

SEQ ID NO: 1562 - DNA, 108 bp, Artificial Sequence
  scaffold variant
tctggcgcttttatctcattactttgagagccatcaccagcgactatgtcgtatgggtaaagcgcttatttatcggagagaaatccgataaataagaaagcatcaaag

SEQ ID NO: 1563 - DNA, 108 bp, Artificial Sequence
  scaffold variant
tactggcgcttttatctcattactttgagagccatcaccagcgactatgtcgtatgggtaaagcggtatttatcggagagaaatcacgataaataagaagcatcaaag

SEQ ID NO: 1564 - DNA, 110 bp, Artificial Sequence
  scaffold variant
tactggcgcttttattctcattactttgagagccatcaccagcgactatgtcgtatgggtaaagcgcttatttatcggagagaagatccgataaataagaagcatcaaag

SEQ ID NO: 1565 - DNA, 106 bp, Artificial Sequence
  scaffold variant
tggcgcttttatctcattactttgagagccatcaccagcgactatgtcgtatgggtaaagcgcttatttatcggcagagaaatccgataaataagaagcatcaaag

SEQ ID NO: 1566 - DNA, 110 bp, Artificial Sequence
  scaffold variant
tactggcgcttttatctcattactttgagagccatcaccagcgactatgtcgtatgggtaaagcgcttatttatcgggagagaaatcgcgataaataagaagcatcaaag

SEQ ID NO: 1567 - DNA, 108 bp, Artificial Sequence
  scaffold variant
tactggcgcttttatctcattactttgagagccatcaccagcgactatgtcgtatgggtaaagcgcttatttatcgagagaaatcgcgataaataagaagcatcaaag

SEQ ID NO: 1568 - DNA, 107 bp, Artificial Sequence; identical to SEQ ID NO: 1307
  scaffold variant

SEQ ID NO: 1569 - DNA, 103 bp, Artificial Sequence
  scaffold variant
ggcgcttttatctcattactttgagagccatcaccagcgactatgtcgtatgggtaaagcgcttatttatcgagagaaatccgataaataagaagcatcaaag

SEQ ID NO: 1570 - DNA, 108 bp, Artificial Sequence
  scaffold variant
tactggcgcttttaatctcattactttgagagccatcaccagcgactatgtcgtatgggtaaagcgcttatttatcgagagaaatccgataaataagaagcatcaaag

SEQ ID NO: 1571 - DNA, 109 bp, Artificial Sequence; identical to SEQ ID NO: 1025
  scaffold variant

SEQ ID NO: 1572 - DNA, 108 bp, Artificial Sequence
  scaffold variant
actggcgcttttatctcattactttgagagccatcaccagcgactatgtcgtatgggtaaagcgcttatttatcggagagaaagtccgataaataagaagcatcaaag

SEQ ID NO: 1573 - DNA, 107 bp, Artificial Sequence; identical to SEQ ID NO: 1081
  scaffold variant

SEQ ID NO: 1574 - DNA, 107 bp, Artificial Sequence; identical to SEQ ID NO: 1017
  scaffold variant

SEQ ID NO: 1575 - DNA, 109 bp, Artificial Sequence; identical to SEQ ID NO: 785
  scaffold variant

SEQ ID NO: 1576 - DNA, 110 bp, Artificial Sequence
  scaffold variant
tactggcgcttttaatctcattactttgagagccatcaccagcgactatgtcgtatgggtaaagcgcttatttatacggagagaaatccgataaataagaagcatcaaag

SEQ ID NO: 1577 - DNA, 108 bp, Artificial Sequence
  scaffold variant
tacctggcgcttttatctcattactttgagagccatcaccagcgactatgtcgtatgggtaaagcgcttatttatcaagagaaatccgataaataagaagcatcaaag

SEQ ID NO: 1578 - DNA, 106 bp, Artificial Sequence; identical to SEQ ID NO: 416
  scaffold variant

SEQ ID NO: 1579 - DNA, 110 bp, Artificial Sequence
  scaffold variant
tactggcgcttttaatctcattactttgagagccatcaccagcgactatgtcgtatgggtaaagcgcttatttatcggagagaaatcacgataaataagaagcatcaaag

SEQ ID NO: 1580 - DNA, 107 bp, Artificial Sequence; identical to SEQ ID NO: 608
  scaffold variant

SEQ ID NO: 1581 - DNA, 108 bp, Artificial Sequence
  scaffold variant
tactggcgcttttatctctattactttgagagccatcaccagcgactatgtcgtatgggtaaagcgcttatttattgagagaaatccgataaataagaagcatcaaag

SEQ ID NO: 1582 - DNA, 106 bp, Artificial Sequence; identical to SEQ ID NO: 1033
  scaffold variant

SEQ ID NO: 1583 - DNA, 107 bp, Artificial Sequence; identical to SEQ ID NO: 1084
  scaffold variant

SEQ ID NO: 1584 - DNA, 105 bp, Artificial Sequence; identical to SEQ ID NO: 1004
  scaffold variant

SEQ ID NO: 1585 - DNA, 107 bp, Artificial Sequence; identical to SEQ ID NO: 1136
  scaffold variant

SEQ ID NO: 1586 - DNA, 106 bp, Artificial Sequence; identical to SEQ ID NO: 678
  scaffold variant

SEQ ID NO: 1587 - DNA, 108 bp, Artificial Sequence
  scaffold variant
gctggcgcttttatctcattactttgagagccatcaccagcgactatgtcgtatgggtaaagcgcttatttatcggagagaaataccgataaataagaagcatcaaag

SEQ ID NO: 1588 - DNA, 108 bp, Artificial Sequence
  scaffold variant
tactggcgcttttatctgcattactttgagagccatcaccagcgactatgtcgtatgggtaaagcgcttatttatcggaagaaatccgataaataagaagcatcaaag

SEQ ID NO: 1589 - DNA, 108 bp, Artificial Sequence
  scaffold variant
tacggcgcttttatctcattactttgagagccatcaccagcgactatgtcgtatgggtaaagcgcttatttatcggagagagaatccgataaataagaagcatcaaag

SEQ ID NO: 1590 - DNA, 108 bp, Artificial Sequence
  scaffold variant
tactggcgcttttatctcattactttgagagccatcaccagcgactatgtcgtatgggtaaagcggtatttatcggagagaaatctcgataaataagaagcatcaaag

SEQ ID NO: 1591 - DNA, 107 bp, Artificial Sequence; identical to SEQ ID NO: 1307
  scaffold variant

SEQ ID NO: 1592 - DNA, 110 bp, Artificial Sequence
  scaffold variant
tactggcgcttttattctcattactttgagagccatcaccagcgactatgtcgtatgggtaaagcgcttattttatcggagagaaatccgataaataagaagcatcaaag

SEQ ID NO: 1593 - DNA, 105 bp, Artificial Sequence
  scaffold variant
tctggcgcttttatctcattactttgagagccatcaccagcgactatgtcgtatgggtaaagcgcttatttatcggagatatccgataaataagaagcatcaaag

SEQ ID NO: 1594 - DNA, 108 bp, Artificial Sequence
  scaffold variant
gctggcgcttttatctctattactttgagagccatcaccagcgactatgtcgtatgggtaaagcgcttatttatcggagagaaatccgataaataagaagcatcaaag

SEQ ID NO: 1595 - DNA, 109 bp, Artificial Sequence; identical to SEQ ID NO: 1228
  scaffold variant

SEQ ID NO: 1596 - DNA, 108 bp, Artificial Sequence
  scaffold variant
tactggcgcttttatctcattactttgagagccatcaccagcgactatgtcgtatgggtaaagcgcttatttctcggagagaaatccgataaataagaagcatcaaag

SEQ ID NO: 1597 - DNA, 110 bp, Artificial Sequence
  scaffold variant
ttactggcgcttttatctcattactttgagagccatcaccagcgactatgtcgtatgggtaaagcgcttatttatcggagagaaataccgataaataagaagcatcaaag

SEQ ID NO: 1598 - DNA, 105 bp, Artificial Sequence
  scaffold variant
tctggcgcttttatctcattactttgagagccatcaccagcgactatgtcgtatgggtaaagcgcttatttatcggagagaaacgataaataagaagcatcaaag

SEQ ID NO: 1599 - DNA, 107 bp, Artificial Sequence
  scaffold variant
tctggcgcttttatctcattactttgagagccatcaccagcgactatgtcgtatgggtaaagcgcttatttatcggagagaaatctgataaataagaagcatcaaag

SEQ ID NO: 1600 - DNA, 109 bp, Artificial Sequence
  scaffold variant
tactggcgcttttatctcattactttgagagccatcaccagcgactatgtcgtatgggtaaagcgcttatttagtcggagagaaatccgataaataagaagcatcaaag

SEQ ID NO: 1601 - DNA, 106 bp, Artificial Sequence
  scaffold variant
gctggcgcttttatctcattactttgagagccatcaccagcgactatgtcgtatgggtaaagcgcttatttatcggagacaatccgataaataagaagcatcaaag

SEQ ID NO: 1602 - DNA, 106 bp, Artificial Sequence
  scaffold variant
actggcgcttttatctcattactttgagagccatcaccagcgactatgtcgtatgggtaaagcgcttatttatcggagagaaatccgatagtaagaagcatcaaag

SEQ ID NO: 1603 - DNA, 108 bp, Artificial Sequence
  scaffold variant
cctggcgcttttatctcattactttgagagccatcaccagcgactatgtcgtatgggtaaagcgcttatttatcggagaagaaatccgataaataagaagcatcaaag

SEQ ID NO: 1604 - DNA, 107 bp, Artificial Sequence; identical to SEQ ID NO: 970
  scaffold variant

SEQ ID NO: 1605 - DNA, 108 bp, Artificial Sequence
  scaffold variant
tactggcgcttttatctctattactttgagagccatcaccagcgactatgtcgtatgggtaaagcgcttatttatcggcagaaatccgataaataagaagcatcaaag

SEQ ID NO: 1606 - DNA, 108 bp, Artificial Sequence
  scaffold variant
tactggcgcttttatcctcattactttgagagccatcaccagcgactatgtcgtatgggtaaagcgcttatttatcggcagaaatccgataaataagaagcatcaaag

SEQ ID NO: 1607 - DNA, 107 bp, Artificial Sequence
  scaffold variant
ctggcgcttttatctcattactttgagagccatcaccagcgactatgtcgtatgggtaaagcgcttatttatcgcgagagaaatccgataaataagaagcatcaaag

SEQ ID NO: 1608 - DNA, 110 bp, Artificial Sequence
  scaffold variant
tactggcgcttttatcctcattactttgagagccatcaccagcgactatgtcgtatgggtaaagcgcttatttatcggagagaaatccgaataaataagaagcatcaaag

SEQ ID NO: 1609 - DNA, 109 bp, Artificial Sequence; identical to SEQ ID NO: 847
  scaffold variant

SEQ ID NO: 1610 - DNA, 107 bp, Artificial Sequence
  scaffold variant
gatggcgcttttatctcattactttgagagccatcaccagcgactatgtcgtatgggtaaagcgcttatttatcggagagaaatccgataaataagaagcatcaaag

SEQ ID NO: 1611 - DNA, 108 bp, Artificial Sequence
  scaffold variant
tactggcgcttttatctgcattactttgagagccatcaccagcgactatgtcgtatgggtaaagcggtatttatcggagagaaatccgataaataagaagcatcaaag

SEQ ID NO: 1612 - DNA, 108 bp, Artificial Sequence
  scaffold variant
tactggcgcttttatctcattactttgagagccatcaccagcgactatgtcgtatgggtaaagcggtatttatcggagagaaatcccgataaataagaagcatcaaag

SEQ ID NO: 1613 - DNA, 107 bp, Artificial Sequence; identical to SEQ ID NO: 878
  scaffold variant

SEQ ID NO: 1614 - DNA, 106 bp, Artificial Sequence
  scaffold variant
actggcgcttttatctcattactttgagagccatcaccagcgactatgtcgtatgggtaaagcgcttatttatcggagagaaagcgataaataagaagcatcaaag

SEQ ID NO: 1615 - DNA, 109 bp, Artificial Sequence
  scaffold variant
tactggcgcttttattctcattactttgagagccatcaccagcgactatgtcgtatgggtaaagcgcttatttatcggtgagaaatccgataaataagaagcatcaaag

SEQ ID NO: 1616 - DNA, 107 bp, Artificial Sequence; identical to SEQ ID NO: 1136
  scaffold variant

SEQ ID NO: 1617 - DNA, 108 bp, Artificial Sequence
  scaffold variant
tactggcgcttttattctcattactttgagagccatcaccagcgactatgtcgtatgggtaaagcgcttatttatcggcagaaatccgataaataagaagcatcaaag

SEQ ID NO: 1618 - DNA, 105 bp, Artificial Sequence
  scaffold variant
gctggcgcttttatctcattactttgagagccatcaccagcgactatgtcgtatgggtaaagcgcttatttatcggagatatccgataaataagaagcatcaaag

SEQ ID NO: 1619 - DNA, 106 bp, Artificial Sequence
  scaffold variant
actggcgcttttatctcattactttgagagccatcaccagcgactatgtcgtatgggtaaagcgcttatttatcggagagaaatccgatgataagaagcatcaaag

SEQ ID NO: 1620 - DNA, 105 bp, Artificial Sequence
  scaffold variant
ctggcgcttttatctcattactttgagagccatcaccagcgactatgtcgtatgggtaaagctttatttatcggagagaaatccgataaataagaagcatcaaag

SEQ ID NO: 1621 - DNA, 105 bp, Artificial Sequence
  scaffold variant
cctggcgcttttatctcattactttgagagccatcaccagcgactatgtcgtatgggtaaagcgcttatttatctgagaaatccgataaataagaagcatcaaag

SEQ ID NO: 1622 - DNA, 108 bp, Artificial Sequence; identical to SEQ ID NO: 419
  scaffold variant

SEQ ID NO: 1623 - DNA, 109 bp, Artificial Sequence; identical to SEQ ID NO: 1025
  scaffold variant

SEQ ID NO: 1624 - DNA, 108 bp, Artificial Sequence
  scaffold variant
tactggcgcttttatctcattactttgagagccatcaccagcgactatgtcgtatgggtaaagcgcttatttacggagagaaatcgcgataaataagaagcatcaaag

SEQ ID NO: 1625 - DNA, 106 bp, Artificial Sequence
  scaffold variant
tacggcgcttttatctcattactttgagagccatcaccagcgactatgtcgtatgggtaaagcgatatttatcggagagaaatccgataaataagaagcatcaaag

SEQ ID NO: 1626 - DNA, 107 bp, Artificial Sequence; identical to SEQ ID NO: 1307
  scaffold variant

SEQ ID NO: 1627 - DNA, 110 bp, Artificial Sequence
  scaffold variant
tactggcgcttttatcctcattactttgagagccatcaccagcgactatgtcgtatgggtaaagcgcttatttatcggagagaaatccggataaataagaagcatcaaag

SEQ ID NO: 1628 - DNA, 107 bp, Artificial Sequence
  scaffold variant
ttactggcgcttttatctcattactttgagagccatcaccagcgactatgtcgtatgggtaaagcgcttatttatcggagaaatccgataaataagaagcatcaaag

SEQ ID NO: 1629 - DNA, 109 bp, Artificial Sequence; identical to SEQ ID NO: 1025
  scaffold variant

SEQ ID NO: 1630 - DNA, 109 bp, Artificial Sequence; identical to SEQ ID NO: 957
  scaffold variant

SEQ ID NO: 1631 - DNA, 107 bp, Artificial Sequence
  scaffold variant
actggcgcttttatctcattactttgagagccatcaccagcgactatgtcgtatgggtaaagcgcttatttttcggagagaaatccgataaataagaagcatcaaag

SEQ ID NO: 1632 - DNA, 107 bp, Artificial Sequence; identical to SEQ ID NO: 1017
  scaffold variant

SEQ ID NO: 1633 - DNA, 110 bp, Artificial Sequence
  scaffold variant
tactggcgcttttatcttcattactttgagagccatcaccagcgactatgtcgtatgggtaaagcgcttatttatcggagagaaatccgaataaataagaagcatcaaag

SEQ ID NO: 1634 - DNA, 110 bp, Artificial Sequence
  scaffold variant
tactggcgcttttattctcattactttgagagccatcaccagcgactatgtcgtatgggtaaagcgcttatttatcggagagaaatccgataaataagagagcatcaaag

SEQ ID NO: 1635 - DNA, 107 bp, Artificial Sequence
  scaffold variant
tactggcgcttttatctcattactttgagagccatcaccagcgactatgtcgtatgggtaaagcgcttatttgaggagagaaatccgataaataagaagcatcaaag

SEQ ID NO: 1636 - DNA, 106 bp, Artificial Sequence; identical to SEQ ID NO: 1046
  scaffold variant

SEQ ID NO: 1637 - DNA, 107 bp, Artificial Sequence; identical to SEQ ID NO: 878
  scaffold variant

SEQ ID NO: 1638 - DNA, 108 bp, Artificial Sequence
  scaffold variant
ttactggcgcttttatctcattactttgagagccatcaccagcgactatgtcgtatgggtaaagcgcttatttatcggagagaaatccataaataagaagcatcaaag

SEQ ID NO: 1639 - DNA, 108 bp, Artificial Sequence
  scaffold variant
tactggcgcttttatcttcattactttgagagccatcaccagcgactatgtcgtatgggtaaagcgcttatttatcggagagaaatccctaaataagaagcatcaaag

SEQ ID NO: 1640 - DNA, 105 bp, Artificial Sequence
  scaffold variant
ctggcgcttttatctcattactttgagagccatcaccagcgactatgtcgtatgggtaaagcattatttatcggagagaaatccgataaataagaagcatcaaag

SEQ ID NO: 1641 - DNA, 109 bp, Artificial Sequence; identical to SEQ ID NO: 563
  scaffold variant

SEQ ID NO: 1642 - DNA, 108 bp, Artificial Sequence
  scaffold variant
tactggcgcttttatctattactttgagagccatcaccagcgactatgtcgtatgggtaaagcgcttatttatcgggagagaaatccgataaataagaagcatcaaag

SEQ ID NO: 1643 - DNA, 109 bp, Artificial Sequence; identical to SEQ ID NO: 847
  scaffold variant

SEQ ID NO: 1644 - DNA, 106 bp, Artificial Sequence
  scaffold variant
gctggcgcttttatctcattactttgagagccatcaccagcgactatgtcgtatgggtaaagcgcttatttatcggaagaaatccgataaataagaagcatcaaag

SEQ ID NO: 1645 - DNA, 108 bp, Artificial Sequence
  scaffold variant
tactggcgcttttattctcattactttgagagccatcaccagcgactatgtcgtatgggtaaagcgcttatttatcggagagtatccgataaataagaagcatcaaag

SEQ ID NO: 1646 - DNA, 106 bp, Artificial Sequence
  scaffold variant
ctggcgcttttatctcattactttgagagccatcaccagcgactatgtcgtatgggtaaagcgcttatttatcggcgagaaatccgataaataagaagcatcaaag

SEQ ID NO: 1647 - DNA, 106 bp, Artificial Sequence
  scaffold variant
gatggcgcttttatctcattactttgagagccatcaccagcgactatgtcgtatgggtaaagcgcttatttatcgagagaaatccgataaataagaagcatcaaag

SEQ ID NO: 1648 - DNA, 106 bp, Artificial Sequence; identical to SEQ ID NO: 782
  scaffold variant

SEQ ID NO: 1649 - DNA, 109 bp, Artificial Sequence; identical to SEQ ID NO: 1062
  scaffold variant

SEQ ID NO: 1650 - DNA, 107 bp, Artificial Sequence; identical to SEQ ID NO: 878
  scaffold variant

SEQ ID NO: 1651 - DNA, 106 bp, Artificial Sequence
  scaffold variant
tactggcgcttttatctcattactttgagagccatcaccagcgactatgtcgtatgggtaaagcggtatttatcggagagaaatcgataaataagaagcatcaaag

SEQ ID NO: 1652 - DNA, 109 bp, Artificial Sequence; identical to SEQ ID NO: 1025
  scaffold variant

SEQ ID NO: 1653 - DNA, 108 bp, Artificial Sequence
  scaffold variant
tacggcgcttttatctcattactttgagagccatcaccagcgactatgtcgtatgggtaaagcgcttatttgatcggagagaaatccgataaataagaagcatcaaag

SEQ ID NO: 1654 - DNA, 110 bp, Artificial Sequence
  scaffold variant
tactggcgcttttatcctcattactttgagagccatcaccagcgactatgtcgtatgggtaaagcgcttatttatcggagagacaatccgataaataagaagcatcaaag

SEQ ID NO: 1655 - DNA, 103 bp, Artificial Sequence
  scaffold variant
tggcgcttttatctcattactttgagagccatcaccagcgactatgtcgtatgggtaaagcgcttatttatcggagaaatccgataaataagaagcatcaaag

SEQ ID NO: 1656 - DNA, 109 bp, Artificial Sequence; identical to SEQ ID NO: 1055
  scaffold variant

SEQ ID NO: 1657 - DNA, 109 bp, Artificial Sequence; identical to SEQ ID NO: 1025
  scaffold variant

SEQ ID NO: 1658 - DNA, 105 bp, Artificial Sequence; identical to SEQ ID NO: 1043
  scaffold variant

SEQ ID NO: 1659 - DNA, 108 bp, Artificial Sequence
  scaffold variant
tacggcgcttttatcctcattactttgagagccatcaccagcgactatgtcgtatgggtaaagcgcttatttatcggagagaaatccgataaataagaagcatcaaag

SEQ ID NO: 1660 - DNA, 109 bp, Artificial Sequence; identical to SEQ ID NO: 847
  scaffold variant

SEQ ID NO: 1661 - DNA, 108 bp, Artificial Sequence
  scaffold variant
tactggcgcttttatctcattactttgagagccatcaccagcgactatgtcgtatgggtaaagcgcttatttacggagagaaatccgataaataagtaagcatcaaag

SEQ ID NO: 1662 - DNA, 104 bp, Artificial Sequence
  scaffold variant
tggcgcttttatctcattactttgagagccatcaccagcgactatgtcgtatgggtaaagcgcttatttattgagagaaatccgataaataagaagcatcaaag

SEQ ID NO: 1663 - DNA, 107 bp, Artificial Sequence
  scaffold variant
tactggcgcttttatctcattactttgagagccatcaccagcgactatgtcgtatgggtaaagcgcttatttatcggagagaaatccggaaataagaagcatcaaag

SEQ ID NO: 1664 - DNA, 110 bp, Artificial Sequence
  scaffold variant
tactggcgcttttatctctattactttgagagccatcaccagcgactatgtcgtatgggtaaagcgcttatttatctggagagaaatccgataaataagaagcatcaaag

SEQ ID NO: 1665 - DNA, 107 bp, Artificial Sequence
  scaffold variant
tctggcgcttttatctcattactttgagagccatcaccagcgactatgtcgtatgggtaaagcgcttatttatcggagagaaatccgctaaataagaagcatcaaag

SEQ ID NO: 1666 - DNA, 107 bp, Artificial Sequence; identical to SEQ ID NO: 1017
  scaffold variant

SEQ ID NO: 1667 - DNA, 109 bp, Artificial Sequence
  scaffold variant
tactggcgcttttatctgcattactttgagagccatcaccagcgactatgtcgtatgggtaaagcgcttatttatcggcgagaaatccgataaataagaagcatcaaag

SEQ ID NO: 1668 - DNA, 108 bp, Artificial Sequence
  scaffold variant
tactggcgcttttatctcattactttgagagccatcaccagcgactatgtcgtatgggtaaagcgcttatttatggagagaaatcgcgataaataagaagcatcaaag

SEQ ID NO: 1669 - DNA, 110 bp, Artificial Sequence
  scaffold variant
tacctggcgcttttatctcattactttgagagccatcaccagcgactatgtcgtatgggtaaagcgcttatttattcggagagaaatccgataaataagaagcatcaaag

SEQ ID NO: 1670 - DNA, 109 bp, Artificial Sequence; identical to SEQ ID NO: 1228
  scaffold variant

SEQ ID NO: 1671 - DNA, 107 bp, Artificial Sequence; identical to SEQ ID NO: 1081
  scaffold variant

SEQ ID NO: 1672 - DNA, 105 bp, Artificial Sequence; identical to SEQ ID NO: 569
  scaffold variant

SEQ ID NO: 1673 - DNA, 110 bp, Artificial Sequence
  scaffold variant
tactggcgcttttatctcattactttgagagccatcaccagcgactatgtcgtatgggtaaagcgcttattttatcggagagaaatcgcgataaataagaagcatcaaag

SEQ ID NO: 1674 - DNA, 108 bp, Artificial Sequence
  scaffold variant
tactggcgcttttatctcattactttgagagccatcaccagcgactatgtcgtatgggtaaagcgcttattttcggagagaaatcccgataaataagaagcatcaaag

SEQ ID NO: 1675 - DNA, 108 bp, Artificial Sequence
  scaffold variant
tactggcgcttttatctcattactttgagagccatcaccagcgactatgtcgtatgggtaaagcgcttatttatcggcgagaaatccgataaataagaagcatcaaag

SEQ ID NO: 1676 - DNA, 108 bp, Artificial Sequence
  scaffold variant
tctggcgcttttatctcattactttgagagccatcaccagcgactatgtcgtatgggtaaagcgcttatttatcggagagacaatccgataaataagaagcatcaaag

SEQ ID NO: 1677 - DNA, 107 bp, Artificial Sequence; identical to SEQ ID NO: 878
  scaffold variant

SEQ ID NO: 1678 - DNA, 109 bp, Artificial Sequence; identical to SEQ ID NO: 1093
  scaffold variant

SEQ ID NO: 1679 - DNA, 107 bp, Artificial Sequence
  scaffold variant
ctggcgcttttatctcattactttgagagccatcaccagcgactatgtcgtatgggtaaagcgcttattctatcggagagaaatccgataaataagaagcatcaaag

SEQ ID NO: 1680 - DNA, 109 bp, Artificial Sequence; identical to SEQ ID NO: 1228
  scaffold variant

SEQ ID NO: 1681 - DNA, 107 bp, Artificial Sequence
  scaffold variant
cctggcgcttttatctcattactttgagagccatcaccagcgactatgtcgtatgggtaaagcgcttatttatcggagagaagtccgataaataagaagcatcaaag

SEQ ID NO: 1682 - DNA, 108 bp, Artificial Sequence
  scaffold variant
ttactggcgcttttatctcattactttgagagccatcaccagcgactatgtcgtatgggtaaagcgcttatttatcggtagaaatccgataaataagaagcatcaaag

SEQ ID NO: 1683 - DNA, 110 bp, Artificial Sequence
  scaffold variant
tactggcgcttttatctcattactttgagagccatcaccagcgactatgtcgtatgggtaaagcgcttatttatgcggagagaaatgccgataaataagaagcatcaaag

SEQ ID NO: 1684 - DNA, 109 bp, Artificial Sequence; identical to SEQ ID NO: 1228
  scaffold variant

SEQ ID NO: 1685 - DNA, 105 bp, Artificial Sequence
  scaffold variant
ctggcgcttttatctcattactttgagagccatcaccagcgactatgtcgtatgggtaaagcgcttatttatcggagacaatccgataaataagaagcatcaaag

SEQ ID NO: 1686 - DNA, 107 bp, Artificial Sequence; identical to SEQ ID NO: 1307
  scaffold variant

SEQ ID NO: 1687 - DNA, 107 bp, Artificial Sequence; identical to SEQ ID NO: 1136
  scaffold variant

SEQ ID NO: 1688 - DNA, 107 bp, Artificial Sequence; identical to SEQ ID NO: 1307
  scaffold variant

SEQ ID NO: 1689 - DNA, 110 bp, Artificial Sequence
  scaffold variant
tactggcgcttttatctgcattactttgagagccatcaccagcgactatgtcgtatgggtaaagcgcttatttatcggagagaaatcctgataaataagaagcatcaaag

SEQ ID NO: 1690 - DNA, 109 bp, Artificial Sequence; identical to SEQ ID NO: 1025
  scaffold variant

SEQ ID NO: 1691 - DNA, 108 bp, Artificial Sequence
  scaffold variant
gctggcgcttttatctcattactttgagagccatcaccagcgactatgtcgtatgggtaaagcgcttattctatcggagagaaatccgataaataagaagcatcaaag

SEQ ID NO: 1692 - DNA, 110 bp, Artificial Sequence
  scaffold variant
tactggcgcttttatctcattactttgagagccatcaccagcgactatgtcgtagtgggtaaagcgcttatttatccggagagaaatccgataaataagaagcatcaaag

SEQ ID NO: 1693 - DNA, 109 bp, Artificial Sequence; identical to SEQ ID NO: 986
  scaffold variant

SEQ ID NO: 1694 - DNA, 109 bp, Artificial Sequence; identical to SEQ ID NO: 1093
  scaffold variant

SEQ ID NO: 1695 - DNA, 103 bp, Artificial Sequence; identical to SEQ ID NO: 1569
  scaffold variant

SEQ ID NO: 1696 - DNA, 109 bp, Artificial Sequence; identical to SEQ ID NO: 847
  scaffold variant

SEQ ID NO: 1697 - DNA, 106 bp, Artificial Sequence; identical to SEQ ID NO: 430
  scaffold variant

SEQ ID NO: 1698 - DNA, 104 bp, Artificial Sequence
  scaffold variant
cctggcgcttttatctcattactttgagagccatcaccagcgactatgtcgtatgggtaaagcgcttatttatcggagagaaagataaataagaagcatcaaag

SEQ ID NO: 1699 - DNA, 110 bp, Artificial Sequence
  scaffold variant
tcactggcgcttttatctcattactttgagagccatcaccagcgactatgtcgtatgggtaaagcgcttatttatcggagagaaatcacgataaataagaagcatcaaag

SEQ ID NO: 1700 - DNA, 110 bp, Artificial Sequence
  scaffold variant
ttactggcgcttttatctcattactttgagagccatcaccagcgactatgtcgtatgggtaaagcgcttatttatcgtgagagaaatccgataaataagaagcatcaaag

SEQ ID NO: 1701 - DNA, 107 bp, Artificial Sequence; identical to SEQ ID NO: 1263
  scaffold variant

SEQ ID NO: 1702 - DNA, 109 bp, Artificial Sequence; identical to SEQ ID NO: 1093
  scaffold variant

SEQ ID NO: 1703 - DNA, 107 bp, Artificial Sequence
  scaffold variant
ctggcgcttttatctcattactttgagagccatcaccagcgactatgtcgtatgggtaaagcgcttattatatcggagagaaatccgataaataagaagcatcaaag

SEQ ID NO: 1704 - DNA, 110 bp, Artificial Sequence
  scaffold variant
tactggcgcttttatcgtcattactttgagagccatcaccagcgactatgtcgtatgggtaaagcgcttatttatcggagagaaatctcgataaataagaagcatcaaag

SEQ ID NO: 1705 - DNA, 106 bp, Artificial Sequence; identical to SEQ ID NO: 816
  scaffold variant

SEQ ID NO: 1706 - DNA, 106 bp, Artificial Sequence
  scaffold variant
gctggcgcttttatctcattactttgagagccatcaccagcgactatgtcgtatgggtaaagcgcttatttatcggagagaatccgataaataagaagcatcaaag

SEQ ID NO: 1707 - DNA, 106 bp, Artificial Sequence
  scaffold variant
actggcgcttttatctcattactttgagagccatcaccagcgactatgtcgtatgggtaaagcgcttatttatcggagagaaatagataaataagaagcatcaaag

SEQ ID NO: 1708 - DNA, 108 bp, Artificial Sequence
  scaffold variant
tactggcgcttttatctctattactttgagagccatcaccagcgactatgtcgtatgggtaaagcgcttatttgcggagagaaatccgataaataagaagcatcaaag

SEQ ID NO: 1709 - DNA, 107 bp, Artificial Sequence; identical to SEQ ID NO: 878
  scaffold variant

SEQ ID NO: 1710 - DNA, 109 bp, Artificial Sequence; identical to SEQ ID NO: 1093
  scaffold variant

SEQ ID NO: 1711 - DNA, 108 bp, Artificial Sequence
  scaffold variant
ttactggcgcttttatctcattactttgagagccatcaccagcgactatgtcgtatgggtaaagcgcttatttacggagagaaatccgataaataagaagcatcaaag

SEQ ID NO: 1712 - DNA, 108 bp, Artificial Sequence
  scaffold variant
gctggcgcttttatctcattactttgagagccatcaccagcgactatgtcgtatgggtaaagcgcttatttatcggagagaaatccgcataaataagaagcatcaaag

SEQ ID NO: 1713 - DNA, 108 bp, Artificial Sequence
  scaffold variant
tactggcgcttttatctcgattactttgagagccatcaccagcgactatgtcgtatgggtaaagcgcttatttatccagagaaatccgataaataagaagcatcaaag

SEQ ID NO: 1714 - DNA, 107 bp, Artificial Sequence; identical to SEQ ID NO: 878
  scaffold variant

SEQ ID NO: 1715 - DNA, 109 bp, Artificial Sequence; identical to SEQ ID NO: 957
  scaffold variant

SEQ ID NO: 1716 - DNA, 106 bp, Artificial Sequence
  scaffold variant
actggcgcttttatctcattactttgagagccatcaccagcgactatgtcgtatgggtaaagcgcttatttgcggagagaaatccgataaataagaagcatcaaag

SEQ ID NO: 1717 - DNA, 103 bp, Artificial Sequence; identical to SEQ ID NO: 1512
  scaffold variant

SEQ ID NO: 1718 - DNA, 107 bp, Artificial Sequence; identical to SEQ ID NO: 1307
  scaffold variant

SEQ ID NO: 1719 - DNA, 109 bp, Artificial Sequence; identical to SEQ ID NO: 785
  scaffold variant

SEQ ID NO: 1720 - DNA, 107 bp, Artificial Sequence
  scaffold variant
cctggcgcttttatctcattactttgagagccatcaccagcgactatgtcgtatgggtaaagcgcttatttagcggagagaaatccgataaataagaagcatcaaag

SEQ ID NO: 1721 - DNA, 105 bp, Artificial Sequence
  scaffold variant
ctggcgcttttatctcattactttgagagccatcaccagcgactatgtcgtatgggtaaagcgcttatttatcggatgaaatccgataaataagaagcatcaaag

SEQ ID NO: 1722 - DNA, 109 bp, Artificial Sequence; identical to SEQ ID NO: 563
  scaffold variant

SEQ ID NO: 1723 - DNA, 107 bp, Artificial Sequence
  scaffold variant
actggcgcttttatctcattactttgagagccatcaccagcgactatgtcgtatgggtaaagcgcttatttatcggagagaaatccgataaataagaagcatcaaag

SEQ ID NO: 1724 - DNA, 107 bp, Artificial Sequence; identical to SEQ ID NO: 552
  scaffold variant

SEQ ID NO: 1725 - DNA, 107 bp, Artificial Sequence; identical to SEQ ID NO: 1136
  scaffold variant

SEQ ID NO: 1726 - DNA, 110 bp, Artificial Sequence
  scaffold variant
tactggcgcttttatcctcattactttgagagccatcaccagcgactatgtcgtatgggtaaagcgcttattctatcggagagaaatccgataaataagaagcatcaaag

SEQ ID NO: 1727 - DNA, 107 bp, Artificial Sequence; identical to SEQ ID NO: 1081
  scaffold variant

SEQ ID NO: 1728 - DNA, 105 bp, Artificial Sequence; identical to SEQ ID NO: 834
  scaffold variant

SEQ ID NO: 1729 - DNA, 109 bp, Artificial Sequence; identical to SEQ ID NO: 1164
  scaffold variant

SEQ ID NO: 1730 - DNA, 108 bp, Artificial Sequence; identical to SEQ ID NO: 450
  scaffold variant

SEQ ID NO: 1731 - DNA, 109 bp, Artificial Sequence; identical to SEQ ID NO: 1093
  scaffold variant

SEQ ID NO: 1732 - DNA, 107 bp, Artificial Sequence; identical to SEQ ID NO: 431
  scaffold variant

SEQ ID NO: 1733 - DNA, 108 bp, Artificial Sequence
  scaffold variant
gctggcgcttttatctcattactttgagagccatcaccagcgactatgtcgtatgggtaaagcgcttatttatcgagagagaaatccgataaataagaagcatcaaag

SEQ ID NO: 1734 - DNA, 109 bp, Artificial Sequence; identical to SEQ ID NO: 957
  scaffold variant

SEQ ID NO: 1735 - DNA, 107 bp, Artificial Sequence; identical to SEQ ID NO: 878
  scaffold variant

SEQ ID NO: 1736 - DNA, 107 bp, Artificial Sequence
  scaffold variant
tactggcgcttttatctcattactttgagagccatcaccagcgactatgtcgtatgggtaaagcgcttattttcggagagaaatccgataaataagaagcatcaaag

SEQ ID NO: 1737 - DNA, 110 bp, Artificial Sequence
  scaffold variant
tactggcgcttttatctctattactttgagagccatcaccagcgactatgtcgtatgggtaaagcgcttatttatcggagagaaatccgcataaataagaagcatcaaag

SEQ ID NO: 1738 - DNA, 106 bp, Artificial Sequence
  scaffold variant
tggcgcttttatctcattactttgagagccatcaccagcgactatgtcgtatgggtaaagcgcttatttatacggagagaaatccgataaataagaagcatcaaag

SEQ ID NO: 1739 - DNA, 107 bp, Artificial Sequence
  scaffold variant
tactggcgcttttatcctcattactttgagagccatcaccagcgactatgtcgtatgggtaaagcgcttatttatcggagaaatccgataaataagaagcatcaaag

SEQ ID NO: 1740 - DNA, 110 bp, Artificial Sequence
  scaffold variant
ttactggcgcttttatctcattactttgagagccatcaccagcgactatgtcgtatgggtaaagcgcttatttatcggagagaaatctcgataaataagaagcatcaaag

SEQ ID NO: 1741 - DNA, 109 bp, Artificial Sequence; identical to SEQ ID NO: 563
  scaffold variant

SEQ ID NO: 1742 - DNA, 106 bp, Artificial Sequence
  scaffold variant
tctggcgcttttatctcattactttgagagccatcaccagcgactatgtcgtatgggtaaagcgcttatttatcggatgaaatccgataaataagaagcatcaaag

SEQ ID NO: 1743 - DNA, 106 bp, Artificial Sequence; identical to SEQ ID NO: 448
  scaffold variant

SEQ ID NO: 1744 - DNA, 105 bp, Artificial Sequence; identical to SEQ ID NO: 523
  scaffold variant

SEQ ID NO: 1745 - DNA, 104 bp, Artificial Sequence
  scaffold variant
tggcgcttttatctcattactttgagagccatcaccagcgactatgtcgtatgggtaaagcgcttatttatcggaggaaatccgataaataagaagcatcaaag

SEQ ID NO: 1746 - DNA, 107 bp, Artificial Sequence
  scaffold variant
cctggcgcttttatctcattactttgagagccatcaccagcgactatgtcgtatgggtaaagcgcttatttatcggagagaaatacgataaataagaagcatcaaag

SEQ ID NO: 1747 - DNA, 108 bp, Artificial Sequence
  scaffold variant
tactggcgcttttatactcattactttgagagccatcaccagcgactatgtcgtatgggtaaagcgcttatttatccagagaaatccgataaataagaagcatcaaag

SEQ ID NO: 1748 - DNA, 107 bp, Artificial Sequence
  scaffold variant
tctggcgcttttatctcattactttgagagccatcaccagcgactatgtcgtatgggtaaagcgcttatttttcggagagaaatccgataaataagaagcatcaaag

SEQ ID NO: 1749 - DNA, 107 bp, Artificial Sequence
  scaffold variant
tactggcgcttttatctcattactttgagagccatcaccagcgactatgtcgtatgggtaaagcgcttatttatcgtcagaaatccgataaataagaagcatcaaag

SEQ ID NO: 1750 - DNA, 106 bp, Artificial Sequence
  scaffold variant
tactggcgcttttattcattactttgagagccatcaccagcgactatgtcgtatgggtaaagcgcttatttatctagagaaatccgataaataagaagcatcaaag

SEQ ID NO: 1751 - DNA, 108 bp, Artificial Sequence
  scaffold variant
tactggcgcttttatctcattactttgagagccatcaccagcgactatgtcgtatgggtaaagcgcttatttattcggagagaatccgataaataagaagcatcaaag

SEQ ID NO: 1752 - DNA, 107 bp, Artificial Sequence
  scaffold variant
tactggcgcttttatctcattactttgagagccatcaccagcgactatgtcgtatgggtaaagcgcttatttatggagagaaatccgataaataagaagcatcaaag

SEQ ID NO: 1753 - DNA, 107 bp, Artificial Sequence
  scaffold variant
tacggcgcttttatctcattactttgagagccatcaccagcgactatgtcgtatgggtaaagcgcttatttatcgtagagaaatccgataaataagaagcatcaaag

SEQ ID NO: 1754 - DNA, 109 bp, Artificial Sequence; identical to SEQ ID NO: 1600
  scaffold variant

SEQ ID NO: 1755 - DNA, 110 bp, Artificial Sequence
  scaffold variant
tactggcgcttttatctcattactttgagagccatcaccagcgactatgtcgtatgggtaaagcgcttatttatacggagagaaatctcgataaataagaagcatcaaag

SEQ ID NO: 1756 - DNA, 107 bp, Artificial Sequence
  scaffold variant
actggcgcttttatctcattactttgagagccatcaccagcgactatgtcgtatgggtaaagcgcttatttatcggagagaaatctgataaataagaagcatcaaag

SEQ ID NO: 1757 - DNA, 108 bp, Artificial Sequence
  scaffold variant
tactggcgcttttatctcattactttgagagccatcaccagcgactatgtcgtatgggtaaagcgcttatttacggagagaaatcccgataaataagaagcatcaaag

SEQ ID NO: 1758 - DNA, 107 bp, Artificial Sequence
  scaffold variant
ctggcgcttttatctcattactttgagagccatcaccagcgactatgtcgtatgggtaaagcgcttatttgatcggagagaaatccgataaataagaagcatcaaag

SEQ ID NO: 1759 - DNA, 108 bp, Artificial Sequence
  scaffold variant
tactggcgcttttatctcgattactttgagagccatcaccagcgactatgtcgtatgggtaaagcgcttatttatcggaagaaatccgataaataagaagcatcaaag

SEQ ID NO: 1760 - DNA, 104 bp, Artificial Sequence
  scaffold variant
ggcgcttttatctcattactttgagagccatcaccagcgactatgtcgtatgggtaaagcgcttatttatcggagagaaatccgataaataagaagcatcaaag

SEQ ID NO: 1761 - DNA, 110 bp, Artificial Sequence
  scaffold variant
tactggcgcttttatctcattactttgagagccatcaccagcgactatgtcgtatgggtaaagcgcttatttatgcggagagaaatccgataaataagtaagcatcaaag

SEQ ID NO: 1762 - DNA, 107 bp, Artificial Sequence
  scaffold variant
gctggcgcttttatctcattactttgagagccatcaccagcgactatgtcgtatgggtaaagcgcttatttttcggagagaaatccgataaataagaagcatcaaag

SEQ ID NO: 1763 - DNA, 108 bp, Artificial Sequence
  scaffold variant
tacggcgcttttatctcattactttgagagccatcaccagcgactatgtcgtatgggtaaagcgcttatcttatcggagagaaatccgataaataagaagcatcaaag

SEQ ID NO: 1764 - DNA, 110 bp, Artificial Sequence
  scaffold variant
tactggcgcttttatctctattactttgagagccatcaccagcgactatgtcgtatgggtaaagcgcttatttatcaggagagaaatccgataaataagaagcatcaaag

SEQ ID NO: 1765 - DNA, 110 bp, Artificial Sequence
  scaffold variant
tactggcgcttttatctgcattactttgagagccatcaccagcgactatgtcgtatgggtaaagcgcttatttatcgtgagagaaatccgataaataagaagcatcaaag

SEQ ID NO: 1766 - DNA, 107 bp, Artificial Sequence
  scaffold variant
atggcgcttttatctcattactttgagagccatcaccagcgactatgtcgtatgggtaaagcgcttatttatcggagagaaatctcgataaataagaagcatcaaag

SEQ ID NO: 1767 - DNA, 109 bp, Artificial Sequence; identical to SEQ ID NO: 1228
  scaffold variant

SEQ ID NO: 1768 - DNA, 106 bp, Artificial Sequence
  scaffold variant
gctggcgcttttatctcattactttgagagccatcaccagcgactatgtcgtatgggtaaagcgcttatttatcggagtaaatccgataaataagaagcatcaaag

SEQ ID NO: 1769 - DNA, 105 bp, Artificial Sequence
  scaffold variant
atggcgcttttatctcattactttgagagccatcaccagcgactatgtcgtatgggtaaagcgcttatttatcggaagaaatccgataaataagaagcatcaaag

SEQ ID NO: 1770 - DNA, 106 bp, Artificial Sequence
  scaffold variant
tactggcgcttttatctattactttgagagccatcaccagcgactatgtcgtatgggtaaagcgcttatttatcgggagaaatccgataaataagaagcatcaaag

SEQ ID NO: 1771 - DNA, 107 bp, Artificial Sequence; identical to SEQ ID NO: 1081
  scaffold variant

SEQ ID NO: 1772 - DNA, 109 bp, Artificial Sequence; identical to SEQ ID NO: 1055
  scaffold variant

SEQ ID NO: 1773 - DNA, 107 bp, Artificial Sequence; identical to SEQ ID NO: 1307
  scaffold variant

SEQ ID NO: 1774 - DNA, 107 bp, Artificial Sequence
  scaffold variant
tacggcgcttttatctcattactttgagagccatcaccagcgactatgtcgtatgggtaaagcgcttatttatcggagagaaatccggtaaataagaagcatcaaag

SEQ ID NO: 1775 - DNA, 107 bp, Artificial Sequence
  scaffold variant
tactggcgcttttatctcattactttgagagccatcaccagcgactatgtcgtatgggtaaagcgcttatttatcggagagaaagcgataaataagaagcatcaaag

SEQ ID NO: 1776 - DNA, 109 bp, Artificial Sequence
  scaffold variant
tactggcgcttttatctaattactttgagagccatcaccagcgactatgtcgtatgggtaaagcgcttatttatgcggagagaaatccgataaataagaagcatcaaag

SEQ ID NO: 1777 - DNA, 105 bp, Artificial Sequence; identical to SEQ ID NO: 653
  scaffold variant

SEQ ID NO: 1778 - DNA, 106 bp, Artificial Sequence
  scaffold variant
cctggcgcttttatctcattactttgagagccatcaccagcgactatgtcgtatgggtaaagcgcttatttatcggagtaaatccgataaataagaagcatcaaag

SEQ ID NO: 1779 - DNA, 110 bp, Artificial Sequence
  scaffold variant
ctactggcgcttttatctcattactttgagagccatcaccagcgactatgtcgtatgggtaaagcgcttatttagtcggagagaaatccgataaataagaagcatcaaag

SEQ ID NO: 1780 - DNA, 108 bp, Artificial Sequence
  scaffold variant
gctggcgcttttatctcattactttgagagccatcaccagcgactatgtcgtatgggtaaagcgcttatttatcgcgagagaaatccgataaataagaagcatcaaag

SEQ ID NO: 1781 - DNA, 107 bp, Artificial Sequence; identical to SEQ ID NO: 1035
  scaffold variant

SEQ ID NO: 1782 - DNA, 107 bp, Artificial Sequence; identical to SEQ ID NO: 1017
  scaffold variant

SEQ ID NO: 1783 - DNA, 109 bp, Artificial Sequence; identical to SEQ ID NO: 1093
  scaffold variant

SEQ ID NO: 1784 - DNA, 110 bp, Artificial Sequence
  scaffold variant
tactggcgcttttattctcattactttgagagccatcaccagcgactatgtcgtatgggtaaagcgcttatttatcaggagagaaatccgataaataagaagcatcaaag

SEQ ID NO: 1785 - DNA, 108 bp, Artificial Sequence
  scaffold variant
ttactggcgcttttatctcattactttgagagccatcaccagcgactatgtcgtatgggtaaagcgcttatttatcggagataatccgataaataagaagcatcaaag

SEQ ID NO: 1786 - DNA, 109 bp, Artificial Sequence; identical to SEQ ID NO: 1055
  scaffold variant

SEQ ID NO: 1787 - DNA, 109 bp, Artificial Sequence; identical to SEQ ID NO: 1228
  scaffold variant

SEQ ID NO: 1788 - DNA, 110 bp, Artificial Sequence
  scaffold variant
atactggcgcttttatctcattactttgagagccatcaccagcgactatgtcgtatgggtaaagcgcttatttatctggagagaaatccgataaataagaagcatcaaag

SEQ ID NO: 1789 - DNA, 107 bp, Artificial Sequence
  scaffold variant
tactggcgcttttatctcattactttgagagccatcaccagcgactatgtcgtatgggtaaagcgcttatttatcggagagaaaacgataaataagaagcatcaaag

SEQ ID NO: 1790 - DNA, 107 bp, Artificial Sequence
  scaffold variant
atggcgcttttatctcattactttgagagccatcaccagcgactatgtcgtatgggtaaagcgcttatttatcggagagaaatcctgataaataagaagcatcaaag

SEQ ID NO: 1791 - DNA, 109 bp, Artificial Sequence; identical to SEQ ID NO: 1228
  scaffold variant

SEQ ID NO: 1792 - DNA, 107 bp, Artificial Sequence; identical to SEQ ID NO: 1307
  scaffold variant

SEQ ID NO: 1793 - DNA, 107 bp, Artificial Sequence; identical to SEQ ID NO: 1017
  scaffold variant

SEQ ID NO: 1794 - DNA, 107 bp, Artificial Sequence
  scaffold variant
cctggcgcttttatctcattactttgagagccatcaccagcgactatgtcgtatgggtaaagcgcttatttatcgcagagaaatccgataaataagaagcatcaaag

SEQ ID NO: 1795 - DNA, 107 bp, Artificial Sequence; identical to SEQ ID NO: 960
  scaffold variant

SEQ ID NO: 1796 - DNA, 110 bp, Artificial Sequence
  scaffold variant
tactggcgcttttatcctcattactttgagagccatcaccagcgactatgtcgtagtgggtaaagcgcttatttatcggagagaaatccgataaataagaagcatcaaag

SEQ ID NO: 1797 - DNA, 105 bp, Artificial Sequence
  scaffold variant
actggcgcttttatctcattactttgagagccatcaccagcgactatgtcgtatgggtaaagcgcttatttatcggagagatccgataaataagaagcatcaaag

SEQ ID NO: 1798 - DNA, 107 bp, Artificial Sequence; identical to SEQ ID NO: 960
  scaffold variant

SEQ ID NO: 1799 - DNA, 107 bp, Artificial Sequence; identical to SEQ ID NO: 1736
  scaffold variant

SEQ ID NO: 1800 - DNA, 109 bp, Artificial Sequence; identical to SEQ ID NO: 785
  scaffold variant

SEQ ID NO: 1801 - DNA, 108 bp, Artificial Sequence
  scaffold variant
actggcgcttttatctcattactttgagagccatcaccagcgactatgtcgtatgggtaaagcgcttatcttatcggagagaaatccgataaataagaagcatcaaag

SEQ ID NO: 1802 - DNA, 107 bp, Artificial Sequence
  scaffold variant
tactggcgcttttatctcattactttgagagccatcaccagcgactatgtcgtatgggtaaagcgcttatttatcggaagaaatccgataaataagaagcatcaaag

SEQ ID NO: 1803 - DNA, 109 bp, Artificial Sequence; identical to SEQ ID NO: 785
  scaffold variant

SEQ ID NO: 1804 - DNA, 109 bp, Artificial Sequence; identical to SEQ ID NO: 785
  scaffold variant

SEQ ID NO: 1805 - DNA, 108 bp, Artificial Sequence
  scaffold variant
tactggcgcttttatctcattactttgagagccatcaccagcgactatgtcgtatgggtaaagcgcttatttatgcggagagaaatccgtaaataagaagcatcaaag

SEQ ID NO: 1806 - DNA, 108 bp, Artificial Sequence
  scaffold variant
tactggcgcttttatctattactttgagagccatcaccagcgactatgtcgtagtgggtaaagcgcttatttatcggagagaaatccgataaataagaagcatcaaag

SEQ ID NO: 1807 - DNA, 109 bp, Artificial Sequence; identical to SEQ ID NO: 563
  scaffold variant

SEQ ID NO: 1808 - DNA, 107 bp, Artificial Sequence; identical to SEQ ID NO: 1084
  scaffold variant

SEQ ID NO: 1809 - DNA, 107 bp, Artificial Sequence; identical to SEQ ID NO: 1142
  scaffold variant

SEQ ID NO: 1810 - DNA, 106 bp, Artificial Sequence; identical to SEQ ID NO: 482
  scaffold variant

SEQ ID NO: 1811 - DNA, 109 bp, Artificial Sequence
  scaffold variant
tactggcgcttttatctcattactttgagagccatcaccagcgactatgtcgtatgggtaaagcgcttatttatcggagagaaatccgagtaaataagaagcatcaaag

SEQ ID NO: 1812 - DNA, 107 bp, Artificial Sequence; identical to SEQ ID NO: 1307
  scaffold variant

SEQ ID NO: 1813 - DNA, 108 bp, Artificial Sequence
  scaffold variant
ctactggcgcttttatctcattactttgagagccatcaccagcgactatgtcgtatgggtaaagcgcttatttatccagagaaatccgataaataagaagcatcaaag

SEQ ID NO: 1814 - DNA, 109 bp, Artificial Sequence
  scaffold variant
tactggcgcttttatctcattactttgagagccatcaccagcgactatgtcgtatgggtaaagcgcttatttataaggagagaaatccgataaataagaagcatcaaag

SEQ ID NO: 1815 - DNA, 107 bp, Artificial Sequence; identical to SEQ ID NO: 878
  scaffold variant

SEQ ID NO: 1816 - DNA, 110 bp, Artificial Sequence
  scaffold variant
tactggcgcttttatctgcattactttgagagccatcaccagcgactatgtcgtatgggtaaagcgcttatttaatcggagagaaatccgataaataagaagcatcaaag

SEQ ID NO: 1817 - DNA, 109 bp, Artificial Sequence; identical to SEQ ID NO: 563
  scaffold variant

SEQ ID NO: 1818 - DNA, 106 bp, Artificial Sequence
  scaffold variant
cctggcgcttttatctattactttgagagccatcaccagcgactatgtcgtatgggtaaagcgcttatttatcggagagaaatccgataaataagaagcatcaaag

SEQ ID NO: 1819 - DNA, 108 bp, Artificial Sequence
  scaffold variant
tactggcgcttttatctattactttgagagccatcaccagcgactatgtcgtatgggtaaagcgcttatttatcggagagaaatcctgataaataagaagcatcaaag

SEQ ID NO: 1820 - DNA, 110 bp, Artificial Sequence
  scaffold variant
tactggcgcttttatctcattactttgagagccatcaccagcgactatgtcgtatgggtaaagcgcttatttatgcggagagaaatccgcataaataagaagcatcaaag

SEQ ID NO: 1821 - DNA, 108 bp, Artificial Sequence
  scaffold variant
tactggcgcttttatctcattactttgagagccatcaccagcgactatgtcgtatgggtaaagcgcttatttatcggaaagaaatccgataaataagaagcatcaaag

SEQ ID NO: 1822 - DNA, 106 bp, Artificial Sequence
  scaffold variant
gctggcgcttttatctcattactttgagagccatcaccagcgactatgtcgtatgggtaaagcgcttatttgcggagagaaatccgataaataagaagcatcaaag

SEQ ID NO: 1823 - DNA, 107 bp, Artificial Sequence; identical to SEQ ID NO: 1307
  scaffold variant

SEQ ID NO: 1824 - DNA, 110 bp, Artificial Sequence
  scaffold variant
tactggcgcttttatctcattactttgagagccatcaccagcgactatgtcgtatgggtaaagcgcttatttatgcggagagaaatcctgataaataagaagcatcaaag

SEQ ID NO: 1825 - DNA, 108 bp, Artificial Sequence
  scaffold variant
cctggcgcttttatctacattactttgagagccatcaccagcgactatgtcgtatgggtaaagcgcttatttatcggagagaaatccgataaataagaagcatcaaag

SEQ ID NO: 1826 - DNA, 110 bp, Artificial Sequence
  scaffold variant
tacctggcgcttttatctcattactttgagagccatcaccagcgactatgtcgtatgggtaaagcgcttatttatcggagagaaatcccgataaataagaagcatcaaag

SEQ ID NO: 1827 - DNA, 108 bp, Artificial Sequence; identical to SEQ ID NO: 419
  scaffold variant

SEQ ID NO: 1828 - DNA, 107 bp, Artificial Sequence; identical to SEQ ID NO: 1017
  scaffold variant

SEQ ID NO: 1829 - DNA, 106 bp, Artificial Sequence
  scaffold variant
ctggcgcttttatctcattactttgagagccatcaccagcgactatgtcgtatgggtaaagcgcttatttatcggagagaaatccgataaataagaagcatcaaag

SEQ ID NO: 1830 - DNA, 110 bp, Artificial Sequence
  scaffold variant
tactggcgcttttatctcattactttgagagccatcaccagcgactatgtcgtatgggtaaagcgcttattttatcggagagaaatcccgataaataagaagcatcaaag

SEQ ID NO: 1831 - DNA, 109 bp, Artificial Sequence
  scaffold variant
tactggcgcttttatctcattactttgagagccatcaccagcgactatgtcgtatgggtaaagcgcttatttaatcggagagaaatccgataaataagaagcatcaaag

SEQ ID NO: 1832 - DNA, 107 bp, Artificial Sequence; identical to SEQ ID NO: 1017
  scaffold variant

SEQ ID NO: 1833 - DNA, 108 bp, Artificial Sequence
  scaffold variant
actggcgcttttatctcattactttgagagccatcaccagcgactatgtcgtatgggtaaagcgcttattgtatcggagagaaatccgataaataagaagcatcaaag

SEQ ID NO: 1834 - DNA, 108 bp, Artificial Sequence
  scaffold variant
tactggcgcttttatctcattactttgagagccatcaccagcgactatgtcgtattgggtaaagcgcttatttatcaagagaaatccgataaataagaagcatcaaag

SEQ ID NO: 1835 - DNA, 108 bp, Artificial Sequence
  scaffold variant
actggcgcttttatctcattactttgagagccatcaccagcgactatgtcgtatgggtaaagcgcttatttatcggagagaaatccgataaataagatagcatcaaag

SEQ ID NO: 1836 - DNA, 107 bp, Artificial Sequence; identical to SEQ ID NO: 878
  scaffold variant

SEQ ID NO: 1837 - DNA, 107 bp, Artificial Sequence; identical to SEQ ID NO: 1081
  scaffold variant

SEQ ID NO: 1838 - DNA, 109 bp, Artificial Sequence; identical to SEQ ID NO: 993
  scaffold variant

SEQ ID NO: 1839 - DNA, 109 bp, Artificial Sequence; identical to SEQ ID NO: 563
  scaffold variant

SEQ ID NO: 1840 - DNA, 108 bp, Artificial Sequence
  scaffold variant
tactggcgcttttatctcattactttgagagccatcaccagcgactatgtcgtatgggtaaagcgcttatttatcgggagagaaatccataaataagaagcatcaaag

SEQ ID NO: 1841 - DNA, 109 bp, Artificial Sequence; identical to SEQ ID NO: 992
  scaffold variant

SEQ ID NO: 1842 - DNA, 107 bp, Artificial Sequence; identical to SEQ ID NO: 1382
  scaffold variant

SEQ ID NO: 1843 - DNA, 109 bp, Artificial Sequence; identical to SEQ ID NO: 957
  scaffold variant

SEQ ID NO: 1844 - DNA, 108 bp, Artificial Sequence
  scaffold variant
tactggcgcttttatctcattactttcgagagccatcaccagcgactatgtcgtatgggtaaagcgcttatttatcggagagaaatggataaataagaagcatcaaag

SEQ ID NO: 1845 - DNA, 108 bp, Artificial Sequence
  scaffold variant
tactggcgcttttatctctattactttgagagccatcaccagcgactatgtcgtatgggtaaagcgcttatttatcggagagaaatccctaaataagaagcatcaaag

SEQ ID NO: 1846 - DNA, 106 bp, Artificial Sequence
  scaffold variant
tctggcgcttttatctcattactttgagagccatcaccagcgactatgtcgtatgggtaaagcgcttatttatcggagagaaagcgataaataagaagcatcaaag

SEQ ID NO: 1847 - DNA, 108 bp, Artificial Sequence
  scaffold variant
cctggcgcttttatctcaattactttgagagccatcaccagcgactatgtcgtatgggtaaagcgcttatttatcggagagaaatccgataaataagaagcatcaaag

SEQ ID NO: 1848 - DNA, 108 bp, Artificial Sequence
  scaffold variant
tactggcgcttttatctcattactttgagagccatcaccagcgactatgtcgtatgggtaaagcgcttatttattcggagagaaatccataaataagaagcatcaaag

SEQ ID NO: 1849 - DNA, 109 bp, Artificial Sequence
  scaffold variant
tactggcgcttttatttcattactttgagagccatcaccagcgactatgtcgtatgggtaaagcgcttatttatgcggagagaaatccgataaataagaagcatcaaag

SEQ ID NO: 1850 - DNA, 106 bp, Artificial Sequence
  scaffold variant
gctggcgcttttatctcattactttgagagccatcaccagcgactatgtcgtatgggtaaagcgcttatttatcggagagaaatccataaataagaagcatcaaag

SEQ ID NO: 1851 - DNA, 110 bp, Artificial Sequence
  scaffold variant
ttactggcgcttttatctcattactttgagagccatcaccagcgactatgtcgtatgggtaaagcgcttattatatcggagagaaatccgataaataagaagcatcaaag

SEQ ID NO: 1852 - DNA, 107 bp, Artificial Sequence; identical to SEQ ID NO: 1307
  scaffold variant

SEQ ID NO: 1853 - DNA, 108 bp, Artificial Sequence
  scaffold variant
ttactggcgcttttatctcattactttgagagccatcaccagcgactatgtcgtatgggtaaagcgcttatttatcggaagaaatccgataaataagaagcatcaaag

SEQ ID NO: 1854 - DNA, 107 bp, Artificial Sequence; identical to SEQ ID NO: 1035
  scaffold variant

SEQ ID NO: 1855 - DNA, 107 bp, Artificial Sequence; identical to SEQ ID NO: 1723
  scaffold variant

SEQ ID NO: 1856 - DNA, 110 bp, Artificial Sequence
  scaffold variant
tactggcgcttttatcttcattactttgagagccatcaccagcgactatgtcgtatgggtaaagcgcttatttatcggagagaaatccgagtaaataagaagcatcaaag

SEQ ID NO: 1857 - DNA, 109 bp, Artificial Sequence; identical to SEQ ID NO: 1164
  scaffold variant

SEQ ID NO: 1858 - DNA, 110 bp, Artificial Sequence
  scaffold variant
tactggcgcttttaatctcattactttgagagccatcaccagcgactatgtcgtatgggtaaagcgcttattctatcggagagaaatccgataaataagaagcatcaaag

SEQ ID NO: 1859 - DNA, 107 bp, Artificial Sequence; identical to SEQ ID NO: 878
  scaffold variant

SEQ ID NO: 1860 - DNA, 109 bp, Artificial Sequence; identical to SEQ ID NO: 1228
  scaffold variant

SEQ ID NO: 1861 - DNA, 110 bp, Artificial Sequence
  scaffold variant
tactggcgcttttatctcattactttgagagccatcaccagcgactatgtcgtatgggtaaagcgcttatttatgcggagagaaatccgataaataagaagcatcaaagc

SEQ ID NO: 1862 - DNA, 109 bp, Artificial Sequence; identical to SEQ ID NO: 785
  scaffold variant

SEQ ID NO: 1863 - DNA, 107 bp, Artificial Sequence; identical to SEQ ID NO: 1307
  scaffold variant

SEQ ID NO: 1864 - DNA, 110 bp, Artificial Sequence
  scaffold variant
atactggcgcttttatctcattactttgagagccatcaccagcgactatgtcgtatgggtaaagcgcttatttatccggagagaaatccgataaataagaagcatcaaag

SEQ ID NO: 1865 - DNA, 107 bp, Artificial Sequence; identical to SEQ ID NO: 878
  scaffold variant

SEQ ID NO: 1866 - DNA, 107 bp, Artificial Sequence; identical to SEQ ID NO: 1736
  scaffold variant

SEQ ID NO: 1867 - DNA, 108 bp, Artificial Sequence
  scaffold variant
gctggcgcttttatctcattactttgagagccatcaccagcgactatgtcgtatgggtaaagcgcttatttatcggtagagaaatccgataaataagaagcatcaaag

SEQ ID NO: 1868 - DNA, 107 bp, Artificial Sequence
  scaffold variant
atggcgcttttatctcattactttgagagccatcaccagcgactatgtcgtatgggtaaagcgcttatttatcaggagagaaatccgataaataagaagcatcaaag

SEQ ID NO: 1869 - DNA, 107 bp, Artificial Sequence; identical to SEQ ID NO: 810
  scaffold variant

SEQ ID NO: 1870 - DNA, 107 bp, Artificial Sequence
  scaffold variant
tactggcgcttttatctgcattactttgagagccatcaccagcgactatgtcgtatgggtaaagcgcttatttatcggagagatccgataaataagaagcatcaaag

SEQ ID NO: 1871 - DNA, 107 bp, Artificial Sequence
  scaffold variant
atggcgcttttatctcattactttgagagccatcaccagcgactatgtcgtatgggtaaagcgcttatttatcggagagaaatccgataaataagagagcatcaaag

SEQ ID NO: 1872 - DNA, 109 bp, Artificial Sequence; identical to SEQ ID NO: 1025
  scaffold variant

SEQ ID NO: 1873 - DNA, 108 bp, Artificial Sequence
  scaffold variant
tactggcgcttttaatctcattactttgagagccatcaccagcgactatgtcgtatgggtaaagcgcttatttattgagagaaatccgataaataagaagcatcaaag

SEQ ID NO: 1874 - DNA, 107 bp, Artificial Sequence
  scaffold variant
ctactggcgcttttatctcattactttgagagccatcaccagcgactatgtcgtatgggtaaagcgcttatttatcggagaaatccgataaataagaagcatcaaag

SEQ ID NO: 1875 - DNA, 107 bp, Artificial Sequence; identical to SEQ ID NO: 1136
  scaffold variant

SEQ ID NO: 1876 - DNA, 109 bp, Artificial Sequence; identical to SEQ ID NO: 955
  scaffold variant

SEQ ID NO: 1877 - DNA, 110 bp, Artificial Sequence
  scaffold variant
tactggcgcttttatctcattactttgagagccatcaccagcgactatgtcgtatgggtaaagcgcttatttatgcggagagaaatccgataaataagagagcatcaaag

SEQ ID NO: 1878 - DNA, 108 bp, Artificial Sequence
  scaffold variant
gctggcgcttttatctcattactttgagagccatcaccagcgactatgtcgtatgggtaaagcgcttatttatcggagagaaatccgataaataagtaagcatcaaag

SEQ ID NO: 1879 - DNA, 109 bp, Artificial Sequence; identical to SEQ ID NO: 785
  scaffold variant

SEQ ID NO: 1880 - DNA, 110 bp, Artificial Sequence
  scaffold variant
tactggcgcttttatctcattactttgagagccatcaccagcgactatgtcgtatgggtaaagcgcttatttatgcggagagaaaatccgataaataagaagcatcaaag

SEQ ID NO: 1881 - DNA, 107 bp, Artificial Sequence; identical to SEQ ID NO: 878
  scaffold variant

SEQ ID NO: 1882 - DNA, 107 bp, Artificial Sequence; identical to SEQ ID NO: 878
  scaffold variant

SEQ ID NO: 1883 - DNA, 107 bp, Artificial Sequence; identical to SEQ ID NO: 608
  scaffold variant

SEQ ID NO: 1884 - DNA, 108 bp, Artificial Sequence
  scaffold variant
tactggcgcttttatctcattactttgagagccatcaccagcgactatgtcgtatgggtaaagcgcttatctatcggagagaaatccgataaataagaagcatcaaag

SEQ ID NO: 1885 - DNA, 108 bp, Artificial Sequence
  scaffold variant
tactggcgcttttatcatcattactttgagagccatcaccagcgactatgtcgtatgggtaaagcgcttatttatcggagagaaatcgataaataagaagcatcaaag

SEQ ID NO: 1886 - DNA, 106 bp, Artificial Sequence; identical to SEQ ID NO: 504
  scaffold variant

SEQ ID NO: 1887 - DNA, 107 bp, Artificial Sequence; identical to SEQ ID NO: 1382
  scaffold variant

SEQ ID NO: 1888 - DNA, 110 bp, Artificial Sequence
  scaffold variant
tactggcgcttttatctctattactttgagagccatcaccagcgactatgtcgtatgggtaaagcgcttatttatcggagagaaatcacgataaataagaagcatcaaag

SEQ ID NO: 1889 - DNA, 107 bp, Artificial Sequence
  scaffold variant
tactggcgcttttatctcattactttgagagccatcaccagcgactatgtcgtatgggtaaagcgcttatttatcggaggaaatccgataaataagaagcatcaaag

SEQ ID NO: 1890 - DNA, 108 bp, Artificial Sequence
  scaffold variant
tactggcgcttttatctgcattactttgagagccatcaccagcgactatgtcgtatgggtaaagcgcttatttatcggagagaatccgataaataagaagcatcaaag

SEQ ID NO: 1891 - DNA, 109 bp, Artificial Sequence; identical to SEQ ID NO: 1228
  scaffold variant

SEQ ID NO: 1892 - DNA, 107 bp, Artificial Sequence
  scaffold variant
tacggcgcttttatctcattactttgagagccatcaccagcgactatgtcgtatgggtaaagcgcttatttatcggagagaaatcagataaataagaagcatcaaag

SEQ ID NO: 1893 - DNA, 110 bp, Artificial Sequence
  scaffold variant
tactggcgcttttaatctcattactttgagagccatcaccagcgactatgtcgtatgggtaaagcgcttatttagtcggagagaaatccgataaataagaagcatcaaag

SEQ ID NO: 1894 - DNA, 110 bp, Artificial Sequence
  scaffold variant
tactggcgcttttatcatcattactttgagagccatcaccagcgactatgtcgtatgggtaaagcgcttatttatctggagagaaatccgataaataagaagcatcaaag

SEQ ID NO: 1895 - DNA, 110 bp, Artificial Sequence
  scaffold variant
tactggcgcttttatcctcattactttgagagccatcaccagcgactatgtcgtatgggtaaagcgcttatttatcggtagagaaatccgataaataagaagcatcaaag

SEQ ID NO: 1896 - DNA, 106 bp, Artificial Sequence
  scaffold variant
actggcgcttttatctcattactttgagagccatcaccagcgactatgtcgtatgggtaaagctttatttatcggagagaaatccgataaataagaagcatcaaag

SEQ ID NO: 1897 - DNA, 108 bp, Artificial Sequence
  scaffold variant
tactggcgcttttatctctattactttgagagccatcaccagcgactatgtcgtatgggtaaagcgcttatttatcggagaggatccgataaataagaagcatcaaag

SEQ ID NO: 1898 - DNA, 108 bp, Artificial Sequence
  scaffold variant
ctactggcgcttttatctcattactttgagagccatcaccagcgactatgtcgtatgggtaaagcgcttatttatcgcgagaaatccgataaataagaagcatcaaag

SEQ ID NO: 1899 - DNA, 108 bp, Artificial Sequence
  scaffold variant
actggcgcttttatctcgattactttgagagccatcaccagcgactatgtcgtatgggtaaagcgcttatttatcggagagaaatccgataaataagaagcatcaaag

SEQ ID NO: 1900 - DNA, 110 bp, Artificial Sequence
  scaffold variant
ttactggcgcttttatctcattactttgagagccatcaccagcgactatgtcgtatgggtaaagcgcttatttatcggagagaaatcctgataaataagaagcatcaaag

SEQ ID NO: 1901 - DNA, 109 bp, Artificial Sequence
  scaffold variant
tactggcgcttttattctcattactttgagagccatcaccagcgactatgtcgtatgggtaaagcgcttatttatcggcgagaaatccgataaataagaagcatcaaag

SEQ ID NO: 1902 - DNA, 107 bp, Artificial Sequence; identical to SEQ ID NO: 560
  scaffold variant

SEQ ID NO: 1903 - DNA, 106 bp, Artificial Sequence
  scaffold variant
tactggcgcttttatctattactttgagagccatcaccagcgactatgtcgtatgggtaaagcgcttatttatcggagagaaatcgataaataagaagcatcaaag

SEQ ID NO: 1904 - DNA, 109 bp, Artificial Sequence
  scaffold variant
tactggcgcttttattctcattactttgagagccatcaccagcgactatgtcgtatgggtaaagcgcttatttgtcggagagaaatccgataaataagaagcatcaaag

SEQ ID NO: 1905 - DNA, 105 bp, Artificial Sequence; identical to SEQ ID NO: 954
  scaffold variant

SEQ ID NO: 1906 - DNA, 109 bp, Artificial Sequence; identical to SEQ ID NO: 616
  scaffold variant

SEQ ID NO: 1907 - DNA, 109 bp, Artificial Sequence; identical to SEQ ID NO: 1190
  scaffold variant

SEQ ID NO: 1908 - DNA, 108 bp, Artificial Sequence
  scaffold variant
tactggcgcttttatctcattactttgagagccatcaccagcgactatgtcgtatgggtaaagcgcttatttatgcggagaggatccgataaataagaagcatcaaag

SEQ ID NO: 1909 - DNA, 110 bp, Artificial Sequence
  scaffold variant
tactggcgcttttatctcattactttgagagccatcaccagcgactatgtcgtagtgggtaaagcgcttatttatcggagagaaatcccgataaataagaagcatcaaag

SEQ ID NO: 1910 - DNA, 106 bp, Artificial Sequence
  scaffold variant
tactggcgcttttaatcattactttgagagccatcaccagcgactatgtcgtatgggtaaagcgcttatttatcgagagaaatccgataaataagaagcatcaaag

SEQ ID NO: 1911 - DNA, 106 bp, Artificial Sequence
  scaffold variant
tactggcgcttttatctcattactttgagagccatcaccagcgactatgtcgtatgggtaaagcgcttatttatcgagagaaatcgataaataagaagcatcaaag

SEQ ID NO: 1912 - DNA, 108 bp, Artificial Sequence
  scaffold variant
actggcgcttttatctcattactttgagagccatcaccagcgactatgtcgtatgggtaaagcgcttatttatcggagagaaatccggataaataagaagcatcaaag

SEQ ID NO: 1913 - DNA, 109 bp, Artificial Sequence; identical to SEQ ID NO: 1025
  scaffold variant

SEQ ID NO: 1914 - DNA, 105 bp, Artificial Sequence
  scaffold variant
atggcgcttttatctcattactttgagagccatcaccagcgactatgtcgtatgggtaaagcgcttatttatcggagagtatccgataaataagaagcatcaaag

SEQ ID NO: 1915 - DNA, 108 bp, Artificial Sequence
  scaffold variant
actggcgcttttatctcattactttgagagccatcaccagcgactatgtcgtatgggtaaagcgcttatttatcggagagaaatccgagtaaataagaagcatcaaag

SEQ ID NO: 1916 - DNA, 108 bp, Artificial Sequence
  scaffold variant
tactggcgcttttatctattactttgagagccatcaccagcgactatgtcgtatgggtaaagcgcttatttatcggcagagaaatccgataaataagaagcatcaaag

SEQ ID NO: 1917 - DNA, 108 bp, Artificial Sequence
  scaffold variant
tactggcgcttttatctcattactttgagagccatcaccagcgactatgtcgtatgggtaaagcgcttatttatcgagagaaatcccgataaataagaagcatcaaag

SEQ ID NO: 1918 - DNA, 109 bp, Artificial Sequence; identical to SEQ ID NO: 1055
  scaffold variant

SEQ ID NO: 1919 - DNA, 107 bp, Artificial Sequence
  scaffold variant
atggcgcttttatctcattactttgagagccatcaccagcgactatgtcgtatgggtaaagcgcttattatatcggagagaaatccgataaataagaagcatcaaag

SEQ ID NO: 1920 - DNA, 107 bp, Artificial Sequence; identical to SEQ ID NO: 1081
  scaffold variant

SEQ ID NO: 1921 - DNA, 107 bp, Artificial Sequence; identical to SEQ ID NO: 1723
  scaffold variant

SEQ ID NO: 1922 - DNA, 109 bp, Artificial Sequence; identical to SEQ ID NO: 1025
  scaffold variant

SEQ ID NO: 1923 - DNA, 108 bp, Artificial Sequence
  scaffold variant
actggcgcttttatctgcattactttgagagccatcaccagcgactatgtcgtatgggtaaagcgcttatttatcggagagaaatccgataaataagaagcatcaaag

SEQ ID NO: 1924 - DNA, 108 bp, Artificial Sequence
  scaffold variant
tactggcgcttttatctcattactttgagagccatcaccagcgactatgtcgtatgggtaaagcgcttatttatcggggagaaatccgataaataagaagcatcaaag

SEQ ID NO: 1925 - DNA, 110 bp, Artificial Sequence
  scaffold variant
tactggcgcttttatctcattactttgagagccatcaccagcgactatgtcgtatgggtaaagcgcttatttagtcggagagaaatcccgataaataagaagcatcaaag

SEQ ID NO: 1926 - DNA, 106 bp, Artificial Sequence
  scaffold variant
gctggcgcttttatctcattactttgagagccatcaccagcgactatgtcgtatgggtaaagcgcttatttatcggtagaaatccgataaataagaagcatcaaag

SEQ ID NO: 1927 - DNA, 107 bp, Artificial Sequence
  scaffold variant
tactggcgcttttatctcattactttgagagccatcaccagcgactatgtcgtatgggtaaagcgcttatttatcggcagaaatccgataaataagaagcatcaaag

SEQ ID NO: 1928 - DNA, 110 bp, Artificial Sequence
  scaffold variant
tactggcgcttttatcctcattactttgagagccatcaccagcgactatgtcgtatgggtaaagcgcttatttatcgagagagaaatccgataaataagaagcatcaaag

SEQ ID NO: 1929 - DNA, 106 bp, Artificial Sequence
  scaffold variant
actggcgcttttatctcattactttgagagccatcaccagcgactatgtcgtatgggtaaagcgcttatttatcggagagaaatccctaaataagaagcatcaaag

SEQ ID NO: 1930 - DNA, 107 bp, Artificial Sequence; identical to SEQ ID NO: 1802
  scaffold variant

SEQ ID NO: 1931 - DNA, 107 bp, Artificial Sequence; identical to SEQ ID NO: 1136
  scaffold variant

SEQ ID NO: 1932 - DNA, 107 bp, Artificial Sequence; identical to SEQ ID NO: 1307
  scaffold variant

SEQ ID NO: 1933 - DNA, 110 bp, Artificial Sequence
  scaffold variant
tactggcgcttttatcctcattactttgagagccatcaccagcgactatgtcgtatgggtaaagcgcttatttatcggagagaaataccgataaataagaagcatcaaag

SEQ ID NO: 1934 - DNA, 106 bp, Artificial Sequence; identical to SEQ ID NO: 1829
  scaffold variant

SEQ ID NO: 1935 - DNA, 106 bp, Artificial Sequence; identical to SEQ ID NO: 1033
  scaffold variant

SEQ ID NO: 1936 - DNA, 107 bp, Artificial Sequence
  scaffold variant
tactggcgcttttatctcattactttgagagccatcaccagcgactatgtcgtatgggtaaagcgcttatttatcggagattatccgataaataagaagcatcaaag

SEQ ID NO: 1937 - DNA, 110 bp, Artificial Sequence
  scaffold variant
tactggcgcttttatctcattactttgagagccatcaccagcgactatgtcgtattgggtaaagcgcttatttatccggagagaaatccgataaataagaagcatcaaag

SEQ ID NO: 1938 - DNA, 110 bp, Artificial Sequence
  scaffold variant
ttactggcgcttttatctcattactttgagagccatcaccagcgactatgtcgtatgggtaaagcgcttatttatccggagagaaatccgataaataagaagcatcaaag

SEQ ID NO: 1939 - DNA, 109 bp, Artificial Sequence; identical to SEQ ID NO: 1055
  scaffold variant

SEQ ID NO: 1940 - DNA, 108 bp, Artificial Sequence
  scaffold variant
tactggcgcttttatctctattactttgagagccatcaccagcgactatgtcgtatgggtaaagcgcttatttatcgcgagaaatccgataaataagaagcatcaaag

SEQ ID NO: 1941 - DNA, 109 bp, Artificial Sequence; identical to SEQ ID NO: 882
  scaffold variant

SEQ ID NO: 1942 - DNA, 107 bp, Artificial Sequence; identical to SEQ ID NO: 1307
  scaffold variant

SEQ ID NO: 1943 - DNA, 107 bp, Artificial Sequence
  scaffold variant
gctggcgcttttatctcattactttgagagccatcaccagcgactatgtcgtatgggtaaagcgcttatttatcggcgagaaatccgataaataagaagcatcaaag

SEQ ID NO: 1944 - DNA, 104 bp, Artificial Sequence
  scaffold variant
ctggcgcttttatctcattactttgagagccatcaccagcgactatgtcgtatgggtaaagcgcttatttatcggggaaatccgataaataagaagcatcaaag

SEQ ID NO: 1945 - DNA, 108 bp, Artificial Sequence
  scaffold variant
tactggcgcttttatctgcattactttgagagccatcaccagcgactatgtcgtatgggtaaagcgcttatttatccagagaaatccgataaataagaagcatcaaag

SEQ ID NO: 1946 - DNA, 107 bp, Artificial Sequence; identical to SEQ ID NO: 1081
  scaffold variant

SEQ ID NO: 1947 - DNA, 110 bp, Artificial Sequence
  scaffold variant
tactggcgcttttatctcattactttgagagccatcaccagcgactatgtcgtatgggtaaagcgcttatttatcgggagagaaatccgataaataagtaagcatcaaag

SEQ ID NO: 1948 - DNA, 109 bp, Artificial Sequence; identical to SEQ ID NO: 1025
  scaffold variant

SEQ ID NO: 1949 - DNA, 107 bp, Artificial Sequence; identical to SEQ ID NO: 1142
  scaffold variant

SEQ ID NO: 1950 - DNA, 107 bp, Artificial Sequence
  scaffold variant
tactggcgcctttatctcattactttgagagccatcaccagcgactatgtcgtatgggtaaagcgcttatttatcgagagaaatccgataaataagaagcatcaaag

SEQ ID NO: 1951 - DNA, 108 bp, Artificial Sequence
  scaffold variant
tactggcgcttttaatctcattactttgagagccatcaccagcgactatgtcgtatgggtaaagcgcttatttatcgggagaaatccgataaataagaagcatcaaag

SEQ ID NO: 1952 - DNA, 107 bp, Artificial Sequence
  scaffold variant
ctggcgcttttatctcattactttgagagccatcaccagcgactatgtcgtatgggtaaagcgcttatttatcggagagaaatccgagtaaataagaagcatcaaag

SEQ ID NO: 1953 - DNA, 108 bp, Artificial Sequence
  scaffold variant
tactggcgcttttattctcattactttgagagccatcaccagcgactatgtcgtatgggtaaagcgcttatttatcggagtaaatccgataaataagaagcatcaaag

SEQ ID NO: 1954 - DNA, 109 bp, Artificial Sequence
  scaffold variant
ttactggcgcttttatctcattactttgagagccatcaccagcgactatgtcgtatgggtaaagcgcttatttatcggtgagaaatccgataaataagaagcatcaaag

SEQ ID NO: 1955 - DNA, 109 bp, Artificial Sequence; identical to SEQ ID NO: 1025
  scaffold variant

SEQ ID NO: 1956 - DNA, 110 bp, Artificial Sequence
  scaffold variant
tactggcgcttttatcttcattactttgagagccatcaccagcgactatgtcgtatgggtaaagcgcttatttatcgtgagagaaatccgataaataagaagcatcaaag

SEQ ID NO: 1957 - DNA, 107 bp, Artificial Sequence
  scaffold variant
tacggcgcttttatctcattactttgagagccatcaccagcgactatgtcgtatgggtaaagcgcttatttatctgagagaaatccgataaataagaagcatcaaag

SEQ ID NO: 1958 - DNA, 109 bp, Artificial Sequence; identical to SEQ ID NO: 616
  scaffold variant

SEQ ID NO: 1959 - DNA, 108 bp, Artificial Sequence; identical to SEQ ID NO: 450
  scaffold variant

SEQ ID NO: 1960 - DNA, 107 bp, Artificial Sequence
  scaffold variant
tctggcgcttttatctcattactttgagagccatcaccagcgactatgtcgtatgggtaaagcgcttatttatcggagagaaatccgataaataagaagcatcaaag

SEQ ID NO: 1961 - DNA, 108 bp, Artificial Sequence
  scaffold variant
tactggcgcttttatcctcattactttgagagccatcaccagcgactatgtcgtatgggtaaagcgcttatttatcggagagaaatccgatagtaagaagcatcaaag

SEQ ID NO: 1962 - DNA, 109 bp, Artificial Sequence
  scaffold variant
cctggcgcttttattctcattactttgagagccatcaccagcgactatgtcgtatgggtaaagcgcttatttatgcggagagaaatccgataaataagaagcatcaaag

SEQ ID NO: 1963 - DNA, 109 bp, Artificial Sequence; identical to SEQ ID NO: 1093
  scaffold variant

SEQ ID NO: 1964 - DNA, 106 bp, Artificial Sequence
  scaffold variant
gctggcgcttttatctcattactttgagagccatcaccagcgactatgtcgtatgggtaaagcgcttatttatcggagagtatccgataaataagaagcatcaaag

SEQ ID NO: 1965 - DNA, 109 bp, Artificial Sequence; identical to SEQ ID NO: 1055
  scaffold variant

SEQ ID NO: 1966 - DNA, 107 bp, Artificial Sequence
  scaffold variant
tactggcgcttttatctcattactttgagagccatcaccagcgactatgtcgtatgggtaaagcggtatttatcggagagaaatccgataaataagaagcatcaaag

SEQ ID NO: 1967 - DNA, 107 bp, Artificial Sequence; identical to SEQ ID NO: 1471
  scaffold variant

SEQ ID NO: 1968 - DNA, 106 bp, Artificial Sequence
  scaffold variant
tggcgcttttatctcattactttgagagccatcaccagcgactatgtcgtatgggtaaagcgcttatttagtcggagagaaatccgataaataagaagcatcaaag

SEQ ID NO: 1969 - DNA, 107 bp, Artificial Sequence; identical to SEQ ID NO: 1723
  scaffold variant

SEQ ID NO: 1970 - DNA, 107 bp, Artificial Sequence; identical to SEQ ID NO: 1136
  scaffold variant

SEQ ID NO: 1971 - DNA, 105 bp, Artificial Sequence
  scaffold variant
cctggcgcttttatctcattactttgagagccatcaccagcgactatgtcgtatgggtaaagcgcttatttatcggtgaaatccgataaataagaagcatcaaag

SEQ ID NO: 1972 - DNA, 107 bp, Artificial Sequence
  scaffold variant
tacggcgcttttatctcattactttgagagccatcaccagcgactatgtcgtatgggtaaagcgcttatttatcggagagaaatccgataaataagaagcatcaaag

SEQ ID NO: 1973 - DNA, 108 bp, Artificial Sequence
  scaffold variant
gatggcgcttttatctcattactttgagagccatcaccagcgactatgtcgtatgggtaaagcgcttatttatgcggagagaaatccgataaataagaagcatcaaag

SEQ ID NO: 1974 - DNA, 107 bp, Artificial Sequence; identical to SEQ ID NO: 878
  scaffold variant

SEQ ID NO: 1975 - DNA, 108 bp, Artificial Sequence
  scaffold variant
tactggcgcttttatctctattactttgagagccatcaccagcgactatgtcgtatgggtaaagcgcttatttatcggagaaaatccgataaataagaagcatcaaag

SEQ ID NO: 1976 - DNA, 108 bp, Artificial Sequence
  scaffold variant
tactggcgcttttatcctcattactttgagagccatcaccagcgactatgtcgtatgggtaaagcgcttatttatcggtagaaatccgataaataagaagcatcaaag

SEQ ID NO: 1977 - DNA, 109 bp, Artificial Sequence; identical to SEQ ID NO: 993
  scaffold variant

SEQ ID NO: 1978 - DNA, 107 bp, Artificial Sequence; identical to SEQ ID NO: 1081
  scaffold variant

SEQ ID NO: 1979 - DNA, 106 bp, Artificial Sequence
  scaffold variant
tactggcgcttttatctcattactttgagagccatcaccagcgactatgtcgtatgggtaaagcgcttatttatcggagaaatccgataaataagaagcatcaaag

SEQ ID NO: 1980 - DNA, 110 bp, Artificial Sequence
  scaffold variant
ttactggcgcttttatctcattactttgagagccatcaccagcgactatgtcgtatgggtaaagcgcttatttatcgggagagaaatccgataaataagaagcatcaaag

SEQ ID NO: 1981 - DNA, 110 bp, Artificial Sequence
  scaffold variant
tactggcgcttttatctcattactttgagagccatcaccagcgactatgtcgtatgggtaaagcgcttatttatccggagagaaatctcgataaataagaagcatcaaag

SEQ ID NO: 1982 - DNA, 109 bp, Artificial Sequence; identical to SEQ ID NO: 955
  scaffold variant

SEQ ID NO: 1983 - DNA, 107 bp, Artificial Sequence; identical to SEQ ID NO: 1752
  scaffold variant

SEQ ID NO: 1984 - DNA, 106 bp, Artificial Sequence; identical to SEQ ID NO: 514
  scaffold variant

SEQ ID NO: 1985 - DNA, 110 bp, Artificial Sequence
  scaffold variant
tactggcgcttttatactcattactttgagagccatcaccagcgactatgtcgtatgggtaaagcgcttatttatcgagagagaaatccgataaataagaagcatcaaag

SEQ ID NO: 1986 - DNA, 107 bp, Artificial Sequence; identical to SEQ ID NO: 1017
  scaffold variant

SEQ ID NO: 1987 - DNA, 110 bp, Artificial Sequence
  scaffold variant
ttactggcgcttttatctcattactttgagagccatcaccagcgactatgtcgtattgggtaaagcgcttatttatcggagagaaatccgataaataagaagcatcaaag

SEQ ID NO: 1988 - DNA, 107 bp, Artificial Sequence; identical to SEQ ID NO: 1307
  scaffold variant

SEQ ID NO: 1989 - DNA, 107 bp, Artificial Sequence; identical to SEQ ID NO: 1802
  scaffold variant

SEQ ID NO: 1990 - DNA, 109 bp, Artificial Sequence; identical to SEQ ID NO: 1025
  scaffold variant

SEQ ID NO: 1991 - DNA, 107 bp, Artificial Sequence; identical to SEQ ID NO: 1307
  scaffold variant

SEQ ID NO: 1992 - DNA, 107 bp, Artificial Sequence; identical to SEQ ID NO: 1972
  scaffold variant

SEQ ID NO: 1993 - DNA, 106 bp, Artificial Sequence
  scaffold variant
tactggcgcttttatctattactttgagagccatcaccagcgactatgtcgtatgggtaaagcgcttatttatcgagagaaatccgataaataagaagcatcaaag

SEQ ID NO: 1994 - DNA, 107 bp, Artificial Sequence; identical to SEQ ID NO: 1736
  scaffold variant

SEQ ID NO: 1995 - DNA, 107 bp, Artificial Sequence; identical to SEQ ID NO: 960
  scaffold variant

SEQ ID NO: 1996 - DNA, 109 bp, Artificial Sequence; identical to SEQ ID NO: 1831
  scaffold variant

SEQ ID NO: 1997 - DNA, 106 bp, Artificial Sequence
  scaffold variant
tactggcgcttttatctattactttgagagccatcaccagcgactatgtcgtatgggtaaagcgcttatttatcaagagaaatccgataaataagaagcatcaaag

SEQ ID NO: 1998 - DNA, 106 bp, Artificial Sequence
  scaffold variant
ctggcgcttttatctcattactttgagagccatcaccagcgactatgtcgtatgggtaaagcgcttatttttcggagagaaatccgataaataagaagcatcaaag

SEQ ID NO: 1999 - DNA, 105 bp, Artificial Sequence; identical to SEQ ID NO: 551
  scaffold variant

SEQ ID NO: 2000 - DNA, 108 bp, Artificial Sequence
  scaffold variant
tactggcgcttttattctcattactttgagagccatcaccagcgactatgtcgtatgggtaaagcgcttatttatcggacgaaatccgataaataagaagcatcaaag

SEQ ID NO: 2001 - DNA, 107 bp, Artificial Sequence
  scaffold variant
gctggcgcttttatctcattactttgagagccatcaccagcgactatgtcgtatgggtaaagcgcttatttagcggagagaaatccgataaataagaagcatcaaag

SEQ ID NO: 2002 - DNA, 110 bp, Artificial Sequence
  scaffold variant
tactggcgcttttatctcattactttgagagccatcaccagcgactatgtcgtatgggtaaagcgcttatttatccggagagaaatccgataaataagagagcatcaaag

SEQ ID NO: 2003 - DNA, 107 bp, Artificial Sequence; identical to SEQ ID NO: 1960
  scaffold variant

SEQ ID NO: 2004 - DNA, 110 bp, Artificial Sequence; identical to SEQ ID NO: 437
  scaffold variant

SEQ ID NO: 2005 - DNA, 106 bp, Artificial Sequence; identical to SEQ ID NO: 733
  scaffold variant

SEQ ID NO: 2006 - DNA, 106 bp, Artificial Sequence
  scaffold variant
actggcgcttttatctcattactttgagagccatcaccagcgactatgtcgtatgggtaaagcgcttatttatcggatgaaatccgataaataagaagcatcaaag

SEQ ID NO: 2007 - DNA, 107 bp, Artificial Sequence
  scaffold variant
ctggcgcttttatcctcattactttgagagccatcaccagcgactatgtcgtatgggtaaagcgcttatttatcggagagaaatccgataaataagaagcatcaaag

SEQ ID NO: 2008 - DNA, 110 bp, Artificial Sequence
  scaffold variant
tactggcgcttttatctcgattactttgagagccatcaccagcgactatgtcgtatgggtaaagcgcttatttatcggagagaaatgccgataaataagaagcatcaaag

SEQ ID NO: 2009 - DNA, 107 bp, Artificial Sequence; identical to SEQ ID NO: 1017
  scaffold variant

SEQ ID NO: 2010 - DNA, 109 bp, Artificial Sequence; identical to SEQ ID NO: 1166
  scaffold variant

SEQ ID NO: 2011 - DNA, 109 bp, Artificial Sequence; identical to SEQ ID NO: 986
  scaffold variant

SEQ ID NO: 2012 - DNA, 107 bp, Artificial Sequence; identical to SEQ ID NO: 1382
  scaffold variant

SEQ ID NO: 2013 - DNA, 109 bp, Artificial Sequence; identical to SEQ ID NO: 1222
  scaffold variant

SEQ ID NO: 2014 - DNA, 108 bp, Artificial Sequence
  scaffold variant
tactggcgcttttatctctattactttgagagccatcaccagcgactatgtcgtatgggtaaagcgcttatttatcggaggaaatccgataaataagaagcatcaaag

SEQ ID NO: 2015 - DNA, 107 bp, Artificial Sequence
  scaffold variant
tactggcgcttttatctcattactttgagagccatcaccagcgactatgtcgtatgggtaaagcgcttatttatcggagacaatccgataaataagaagcatcaaag

SEQ ID NO: 2016 - DNA, 109 bp, Artificial Sequence; identical to SEQ ID NO: 563
  scaffold variant

SEQ ID NO: 2017 - DNA, 108 bp, Artificial Sequence
  scaffold variant
tactggcgcttttatcttcattactttgagagccatcaccagcgactatgtcgtatgggtaaagcgcttatttatcggagagaaaacgataaataagaagcatcaaag

SEQ ID NO: 2018 - DNA, 109 bp, Artificial Sequence
  scaffold variant
tactggcgcttttatcttattactttgagagccatcaccagcgactatgtcgtatgggtaaagcgcttatttatgcggagagaaatccgataaataagaagcatcaaag

SEQ ID NO: 2019 - DNA, 107 bp, Artificial Sequence
  scaffold variant
atggcgcttttatctcattactttgagagccatcaccagcgactatgtcgtatgggtaaagcgcttatttatcggagagaaatgccgataaataagaagcatcaaag

SEQ ID NO: 2020 - DNA, 107 bp, Artificial Sequence
  scaffold variant
tactggcgcttttatctaattactttgagagccatcaccagcgactatgtcgtatgggtaaagcgcttatttatcgagagaaatccgataaataagaagcatcaaag

SEQ ID NO: 2021 - DNA, 110 bp, Artificial Sequence
  scaffold variant
tactggcgcttttatctcattactttgagagccatcaccagcgactatgtcgtatgggtaaagcgcttatttatcgggagagaaatccgataaataagaaagcatcaaag

SEQ ID NO: 2022 - DNA, 107 bp, Artificial Sequence; identical to SEQ ID NO: 1723
  scaffold variant

SEQ ID NO: 2023 - DNA, 108 bp, Artificial Sequence
  scaffold variant
cctggcgcttttatcatcattactttgagagccatcaccagcgactatgtcgtatgggtaaagcgcttatttatcggagagaaatccgataaataagaagcatcaaag

SEQ ID NO: 2024 - DNA, 109 bp, Artificial Sequence; identical to SEQ ID NO: 563
  scaffold variant

SEQ ID NO: 2025 - DNA, 108 bp, Artificial Sequence
  scaffold variant
ttactggcgcttttatctcattactttgagagccatcaccagcgactatgtcgtatgggtaaagcgcttatttatcgtgagaaatccgataaataagaagcatcaaag

SEQ ID NO: 2026 - DNA, 110 bp, Artificial Sequence
  scaffold variant
tactggcgcttttatctcgattactttgagagccatcaccagcgactatgtcgtatgggtaaagcgcttatttaatcggagagaaatccgataaataagaagcatcaaag

SEQ ID NO: 2027 - DNA, 109 bp, Artificial Sequence; identical to SEQ ID NO: 1093
  scaffold variant

SEQ ID NO: 2028 - DNA, 105 bp, Artificial Sequence; identical to SEQ ID NO: 424
  scaffold variant

SEQ ID NO: 2029 - DNA, 105 bp, Artificial Sequence; identical to SEQ ID NO: 1004
  scaffold variant

SEQ ID NO: 2030 - DNA, 107 bp, Artificial Sequence; identical to SEQ ID NO: 960
  scaffold variant

SEQ ID NO: 2031 - DNA, 107 bp, Artificial Sequence; identical to SEQ ID NO: 1017
  scaffold variant

SEQ ID NO: 2032 - DNA, 108 bp, Artificial Sequence
  scaffold variant
tactggcgcttttatctcattactttgagagccatcaccagcgactatgtcgtatgggtaaagcgcttatttatccggagagaatccgataaataagaagcatcaaag

SEQ ID NO: 2033 - DNA, 108 bp, Artificial Sequence
  scaffold variant
tactggcgcttttattcattactttgagagccatcaccagcgactatgtcgtatgggtaaagcgcttatttatcggagagaaatcgcgataaataagaagcatcaaag

SEQ ID NO: 2034 - DNA, 109 bp, Artificial Sequence; identical to SEQ ID NO: 1228
  scaffold variant

SEQ ID NO: 2035 - DNA, 107 bp, Artificial Sequence; identical to SEQ ID NO: 1960
  scaffold variant

SEQ ID NO: 2036 - DNA, 108 bp, Artificial Sequence
  scaffold variant
tactggcgcttttatctcattactttgagagccatcaccagcgactatgtcgtatgggtaaagcgcttatttatcggagagaaatacgataaataagaagcatcaaag

SEQ ID NO: 2037 - DNA, 107 bp, Artificial Sequence; identical to SEQ ID NO: 1035
  scaffold variant

SEQ ID NO: 2038 - DNA, 107 bp, Artificial Sequence; identical to SEQ ID NO: 960
  scaffold variant

SEQ ID NO: 2039 - DNA, 106 bp, Artificial Sequence; identical to SEQ ID NO: 1829
  scaffold variant

SEQ ID NO: 2040 - DNA, 103 bp, Artificial Sequence
  scaffold variant
ggcgcttttatctcattactttgagagccatcaccagcgactatgtcgtatgggtaaagcgcttatttatcaagagaaatccgataaataagaagcatcaaag

SEQ ID NO: 2041 - DNA, 108 bp, Artificial Sequence
  scaffold variant
tactggcgcttttatcctcattactttgagagccatcaccagcgactatgtcgtatgggtaaagcgcttatttatcggagagaatccgataaataagaagcatcaaag

SEQ ID NO: 2042 - DNA, 109 bp, Artificial Sequence; identical to SEQ ID NO: 955
  scaffold variant

SEQ ID NO: 2043 - DNA, 107 bp, Artificial Sequence; identical to SEQ ID NO: 1263
  scaffold variant

SEQ ID NO: 2044 - DNA, 108 bp, Artificial Sequence
  scaffold variant
tactggcgcttttatctgcattactttgagagccatcaccagcgactatgtcgtatgggtaaagcgcttatttatcgtgagaaatccgataaataagaagcatcaaag

SEQ ID NO: 2045 - DNA, 108 bp, Artificial Sequence
  scaffold variant
tactggcgcttttatctcattactttgagagccatcaccagcgactatgtcgtatgggtaaagcgcttatttatcgagagaaatccgaataaataagaagcatcaaag

SEQ ID NO: 2046 - DNA, 106 bp, Artificial Sequence
  scaffold variant
tactggcgcttttatctcattactttgagagccatcaccagcgactatgtcgtatgggtaaagcggtatttatcggagagaaatccataaataagaagcatcaaag

SEQ ID NO: 2047 - DNA, 107 bp, Artificial Sequence; identical to SEQ ID NO: 1035
  scaffold variant

SEQ ID NO: 2048 - DNA, 108 bp, Artificial Sequence
  scaffold variant
tactggcgcttttatctcattactttgagagccatcaccagcgactatgtcgtatgggtaaagcgatatttatcggagagaaatcgcgataaataagaagcatcaaag

SEQ ID NO: 2049 - DNA, 108 bp, Artificial Sequence
  scaffold variant
tactggcgcttttatctcattactttgagagccatcaccagcgactatgtcgtagtgggtaaagcgcttatttatctagagaaatccgataaataagaagcatcaaag

SEQ ID NO: 2050 - DNA, 107 bp, Artificial Sequence; identical to SEQ ID NO: 878
  scaffold variant

SEQ ID NO: 2051 - DNA, 110 bp, Artificial Sequence
  scaffold variant
ttactggcgcttttatctcattactttgagagccatcaccagcgactatgtcgtatgggtaaagcgcttatttatcgcgagagaaatccgataaataagaagcatcaaag

SEQ ID NO: 2052 - DNA, 108 bp, Artificial Sequence
  scaffold variant
tactggcgcttttatctcattactttgagagccatcaccagcgactatgtcgtattgggtaaagcgcttatttatcggagagaaatcgataaataagaagcatcaaag

SEQ ID NO: 2053 - DNA, 110 bp, Artificial Sequence
  scaffold variant
atactggcgcttttatctcattactttgagagccatcaccagcgactatgtcgtatgggtaaagcgcttatttatacggagagaaatccgataaataagaagcatcaaag

SEQ ID NO: 2054 - DNA, 110 bp, Artificial Sequence
  scaffold variant
tacctggcgcttttatctcattactttgagagccatcaccagcgactatgtcgtatgggtaaagcgcttatttactcggagagaaatccgataaataagaagcatcaaag

SEQ ID NO: 2055 - DNA, 106 bp, Artificial Sequence; identical to SEQ ID NO: 536
  scaffold variant

SEQ ID NO: 2056 - DNA, 107 bp, Artificial Sequence; identical to SEQ ID NO: 1035
  scaffold variant

SEQ ID NO: 2057 - DNA, 108 bp, Artificial Sequence
  scaffold variant
gctggcgcttttatctcgattactttgagagccatcaccagcgactatgtcgtatgggtaaagcgcttatttatcggagagaaatccgataaataagaagcatcaaag

SEQ ID NO: 2058 - DNA, 107 bp, Artificial Sequence; identical to SEQ ID NO: 1182
  scaffold variant

SEQ ID NO: 2059 - DNA, 109 bp, Artificial Sequence; identical to SEQ ID NO: 1164
  scaffold variant

SEQ ID NO: 2060 - DNA, 104 bp, Artificial Sequence
  scaffold variant
tggcgcttttatctcattactttgagagccatcaccagcgactatgtcgtatgggtaaagcgcttatttatcggagagaaatccgtaaataagaagcatcaaag

SEQ ID NO: 2061 - DNA, 109 bp, Artificial Sequence; identical to SEQ ID NO: 955
  scaffold variant

SEQ ID NO: 2062 - DNA, 109 bp, Artificial Sequence; identical to SEQ ID NO: 785
  scaffold variant

SEQ ID NO: 2063 - DNA, 107 bp, Artificial Sequence
  scaffold variant
tactggcgcttttatctcattactttgagagccatcaccagcgactatgtcgtatgggtaaagcgcttatttatcttgagaaatccgataaataagaagcatcaaag

SEQ ID NO: 2064 - DNA, 110 bp, Artificial Sequence
  scaffold variant
tactggcgcttttatctcattactttgagagccatcaccagcgactatgtcgtagtgggtaaagcgcttatttatcggagagaaatgccgataaataagaagcatcaaag

SEQ ID NO: 2065 - DNA, 108 bp, Artificial Sequence
  scaffold variant
tactggcgcttttatctcattactttgagagccatcaccagcgactatgtcgtatgggtaaagcgcttatttatcgggagaaatccgataaataagaaagcatcaaag

SEQ ID NO: 2066 - DNA, 107 bp, Artificial Sequence; identical to SEQ ID NO: 1263
  scaffold variant

SEQ ID NO: 2067 - DNA, 108 bp, Artificial Sequence
  scaffold variant
tactggcgcttttatcttttactttgagagccatcaccagcgactatgtcgtatgggtaaagcgcttatttattcggagagaaatccgataaataagaagcatcaaag

SEQ ID NO: 2068 - DNA, 108 bp, Artificial Sequence
  scaffold variant
tactggcgcttttatctcattactttgagagccatcaccagcgactatgtcgtattgggtaaagcgcttatttatccagagaaatccgataaataagaagcatcaaag

SEQ ID NO: 2069 - DNA, 110 bp, Artificial Sequence
  scaffold variant
tactggcgcttttatcctcattactttgagagccatcaccagcgactatgtcgtatgggtaaagcgcttatttatcgcgagagaaatccgataaataagaagcatcaaag

SEQ ID NO: 2070 - DNA, 107 bp, Artificial Sequence; identical to SEQ ID NO: 1382
  scaffold variant

SEQ ID NO: 2071 - DNA, 110 bp, Artificial Sequence
  scaffold variant
tactggcgcttttatcctcattactttgagagccatcaccagcgactatgtcgtatgggtaaagcgcttatttatcggagagaaatcctgataaataagaagcatcaaag

SEQ ID NO: 2072 - DNA, 106 bp, Artificial Sequence; identical to SEQ ID NO: 782
  scaffold variant

SEQ ID NO: 2073 - DNA, 107 bp, Artificial Sequence
  scaffold variant
cctggcgcttttatctcattactttgagagccatcaccagcgactatgtcgtatgggtaaagcgcttatttatcggagaggaatccgataaataagaagcatcaaag

SEQ ID NO: 2074 - DNA, 107 bp, Artificial Sequence; identical to SEQ ID NO: 1382
  scaffold variant

SEQ ID NO: 2075 - DNA, 108 bp, Artificial Sequence
  scaffold variant
tactggcgcttttatctcattactttgagagccatcaccagcgactatgtcgtatgggtaaagcggtatttatcggagagaaatgccgataaataagaagcatcaaag

SEQ ID NO: 2076 - DNA, 109 bp, Artificial Sequence; identical to SEQ ID NO: 955
  scaffold variant

SEQ ID NO: 2077 - DNA, 107 bp, Artificial Sequence; identical to SEQ ID NO: 878
  scaffold variant

SEQ ID NO: 2078 - DNA, 109 bp, Artificial Sequence
  scaffold variant
tactggcgcttttattctcattactttgagagccatcaccagcgactatgtcgtatgggtaaagcgcttatttctcggagagaaatccgataaataagaagcatcaaag

SEQ ID NO: 2079 - DNA, 109 bp, Artificial Sequence; identical to SEQ ID NO: 957
  scaffold variant

SEQ ID NO: 2080 - DNA, 107 bp, Artificial Sequence
  scaffold variant
tactggcgcttttatctcattactttgagagccatcaccagcgactatgtcgtatgggtaaagcgcttatttatcggatgaaatccgataaataagaagcatcaaag

SEQ ID NO: 2081 - DNA, 107 bp, Artificial Sequence; identical to SEQ ID NO: 1752
  scaffold variant

SEQ ID NO: 2082 - DNA, 109 bp, Artificial Sequence; identical to SEQ ID NO: 957
  scaffold variant

SEQ ID NO: 2083 - DNA, 107 bp, Artificial Sequence; identical to SEQ ID NO: 1035
  scaffold variant

SEQ ID NO: 2084 - DNA, 107 bp, Artificial Sequence
  scaffold variant
actggcgcttttatctcattactttgagagccatcaccagcgactatgtcgtatgggtaaagcgcttatttatcggagagaaattcgataaataagaagcatcaaag

SEQ ID NO: 2085 - DNA, 108 bp, Artificial Sequence
  scaffold variant
atactggcgcttttatctcattactttgagagccatcaccagcgactatgtcgtatgggtaaagcgcttatttatcgcgagaaatccgataaataagaagcatcaaag

SEQ ID NO: 2086 - DNA, 108 bp, Artificial Sequence; identical to SEQ ID NO: 531
  scaffold variant

SEQ ID NO: 2087 - DNA, 108 bp, Artificial Sequence
  scaffold variant
tactggcgcttttatctcattactttgagagccatcaccagcgactatgtcgtatgggtaaagcgcttatttatgcggagagaaatccgatagtaagaagcatcaaag

SEQ ID NO: 2088 - DNA, 109 bp, Artificial Sequence; identical to SEQ ID NO: 1228
  scaffold variant

SEQ ID NO: 2089 - DNA, 110 bp, Artificial Sequence
  scaffold variant
tactggcgcttttatctcgattactttgagagccatcaccagcgactatgtcgtatgggtaaagcgcttatttatcggagagaaatcccgataaataagaagcatcaaag

SEQ ID NO: 2090 - DNA, 109 bp, Artificial Sequence; identical to SEQ ID NO: 1241
  scaffold variant

SEQ ID NO: 2091 - DNA, 107 bp, Artificial Sequence; identical to SEQ ID NO: 1960
  scaffold variant

SEQ ID NO: 2092 - DNA, 107 bp, Artificial Sequence
  scaffold variant
tactggcccttttatctcattactttgagagccatcaccagcgactatgtcgtatgggtaaagcgcttatttatcgagagaaatccgataaataagaagcatcaaag

SEQ ID NO: 2093 - DNA, 105 bp, Artificial Sequence
  scaffold variant
actggcgcttttatctcattactttgagagccatcaccagcgactatgtcgtatgggtaaagcgcttatttatcggagatatccgataaataagaagcatcaaag

SEQ ID NO: 2094 - DNA, 107 bp, Artificial Sequence; identical to SEQ ID NO: 1752
  scaffold variant

SEQ ID NO: 2095 - DNA, 108 bp, Artificial Sequence
  scaffold variant
tactggcgcttttatcctcattactttgagagccatcaccagcgactatgtcgtatgggtaaagcgcttatttatcggagagaaaccgataaataagaagcatcaaag

SEQ ID NO: 2096 - DNA, 107 bp, Artificial Sequence; identical to SEQ ID NO: 1960
  scaffold variant

SEQ ID NO: 2097 - DNA, 108 bp, Artificial Sequence
  scaffold variant
actggcgcttttatctcattactttgagagccatcaccagcgactatgtcgtatgggtaaagcgcttatttatcggagagaatatccgataaataagaagcatcaaag

SEQ ID NO: 2098 - DNA, 107 bp, Artificial Sequence; identical to SEQ ID NO: 1960
  scaffold variant

SEQ ID NO: 2099 - DNA, 107 bp, Artificial Sequence; identical to SEQ ID NO: 878
  scaffold variant

SEQ ID NO: 2100 - DNA, 107 bp, Artificial Sequence
  scaffold variant
tactggcgcttttatctcattactttgagagccatcaccagcgactatgtcgtatgggtaaagcgcttatttatcggagagaaatagataaataagaagcatcaaag

SEQ ID NO: 2101 - RNA, 108 nt, Artificial Sequence
  gNA Variant Scaffold
uacuggcgcuuuuaucucauuacuuugagagccaucaccagcgacuaugucguauggguaaagcgcaggugggacgaccucucggucguccuaucugaagcaucaaag

SEQ ID NO: 2102 - RNA, 99 nt, Artificial Sequence
  gNA Variant Scaffold
uacuggcgcuuuuaucucauuacuuugagagccaucaccagcgacuaugucguauggguaaagcgcugcucgacgcguccucgagcagaagcaucaaag

SEQ ID NO: 2103 - RNA, 97 nt, Artificial Sequence
  gNA Variant Scaffold
uacuggcgcuuuuaucucauuacuuugagagccaucaccagcgacuaugucguauggguaaagcgcugcucgcuccguucgagcagaagcaucaaag

SEQ ID NO: 2104 - RNA, 91 nt, Artificial Sequence
  gNA Variant Scaffold
guacuggcgcuuuuaucucauuacuuugagagccaucaccagcgacuaugucguauggguaaagcgcccucuucggagggaagcaucaaag

SEQ ID NO: 2105 - RNA, 99 nt, Artificial Sequence
  gNA Variant Scaffold
uacuggcgcuuuuaucucauuacuuugagagccaucaccagcgacuaugucguauggguaaagcgcaggaguuucuauggaaacccugaagcaucaaag

SEQ ID NO: 2106 - RNA, 99 nt, Artificial Sequence
  gNA Variant Scaffold
guacuggcgccuuuaucucauuacuuugagagccaucaccagcgacuaugucguauggguaaagcgcuuacggacuucgguccguaagaagcaucaaag

SEQ ID NO: 2107 - RNA, 90 nt, Artificial Sequence
  gNA Variant Scaffold
uacuggcgcuuuuaucucauuacuuugagagccaucaccagcgacuaugucguauggguaaagcgcugcgcuugcgcagaagcaucaaag

SEQ ID NO: 2108 - RNA, 108 nt, Artificial Sequence
  gNA Variant Scaffold
uacuggcgcuuuuaucugauuacuuugagagccaucaccagcgacuaugucguauggguaaagcgcuuauuuaucggagagaaauccgauaaauaagaagcaucaaag

SEQ ID NO: 2109 - RNA, 108 nt, Artificial Sequence
  gNA Variant Scaffold
uacuggcgcuuuuaucgcauuacuuugagagccaucaccagcgacuaugucguauggguaaagcgcuuauuuaucggagagaaauccgauaaauaagaagcaucaaag

SEQ ID NO: 2110 - RNA, 110 nt, Artificial Sequence
  gNA Variant Scaffold
uacuggcgcuuuuaucucauuacuuugagagccaucaccagcgacuaugucguauggguaaagcgcuuauuuaucggagacuucgguccgauaaauaagaagcaucaaag

SEQ ID NO: 2111 - RNA, 97 nt, Artificial Sequence
  gNA Variant Scaffold
uacuggcgcuuuuaucucauuacuuugagagccaucaccagcgacuaugucguauggguaaagcgcacaugaggauuacccaugugaagcaucaaag

SEQ ID NO: 2112 - RNA, 106 nt, Artificial Sequence
  gNA Variant Scaffold
gcuggcgcuuuuaucucauuacuuugagagccaucaccagcgacuaugucguauggguaaagcgcuuauuuaucgugagaaauccgauaaauaagaagcaucaaag

SEQ ID NO: 2113 - RNA, 96 nt, Artificial Sequence
  gNA Variant Scaffold
uacuggcgcuuuuaucucauuacuuugagagccaucaccagcgacuaugucguauggguaaagcgcugcaugucuaagacagcagaagcaucaaag

SEQ ID NO: 2114 - RNA, 90 nt, Artificial Sequence
  gNA Variant Scaffold
uacuggcgcuuuuaucucauuacuuugagagccaucaccagcgacuaugucguauggguaaagcgcagggcuucggccgaagcaucaaag

SEQ ID NO: 2115 - RNA, 98 nt, Artificial Sequence
  gNA Variant Scaffold
uacuggcgcuuuuaucucauuacuuugagagccaucaccagcgacuaugucguauggguaaagcgcaauccauugcacuccggauugaagcaucaaag

SEQ ID NO: 2116 - RNA, 108 nt, Artificial Sequence
  gNA Variant Scaffold
uacuggcgcuuuucucgcauuacuuugagagccaucaccagcgacuaugucguauggguaaagcgcuuauuuaucggagagaaauccgauaaauaagaagcaucaaag

SEQ ID NO: 2117 - RNA, 108 nt, Artificial Sequence
  gNA Variant Scaffold
uacuggcgcuuuuaucucauuacuuugagagccaucaccagcgacuaugucguauggguaaagcgcuuauuuaucggacuucgguccgauaaauaagaagcaucaaag

SEQ ID NO: 2118 - RNA, 100 nt, Artificial Sequence
  gNA Variant Scaffold
uacuggcgcuuuuaucucauuacuuugagagccaucaccagcgacuaugucguauggguaaagcgcugcucguuugcggcuacgagcagaagcaucaaag

SEQ ID NO: 2119 - RNA, 100 nt, Artificial Sequence
  gNA Variant Scaffold
uacuggcgcuuuuaucucauuacuuugagagccaucaccagcgacuaugucguauggguaaagcgcuuauuuaucgagagauaaauaagaagcaucaaag

SEQ ID NO: 2120 - RNA, 107 nt, Artificial Sequence
  gNA Variant Scaffold
uacggcgcuuuuaucucauuacuuugagagccaucaccagcgacuaugucguauggguaaagcgcuuauuuaucggagagaaauccgauaaauaagaagcaucaaag

SEQ ID NO: 2121 - RNA, 99 nt, Artificial Sequence
  gNA Variant Scaffold
uacuggcgccuuuuaucucauuacuuugagagccaucaccagcgacuaugucguauggguaaagcgcuuacggacuucgguccguaagaagcaucaaag

SEQ ID NO: 2122 - RNA, 108 nt, Artificial Sequence
  gNA Variant Scaffold
uacuggcgcuuuuaucucauuacuuugagagccaucaccagcgacuaugucguaucgguaaagcgcuuauuuaucggagagaaauccgauaaauaagaagcaucaaag

SEQ ID NO: 2123 - RNA, 108 nt, Artificial Sequence
  gNA Variant Scaffold
uacuggcgccuuuaucucauuacuuugagagccaucaccagcgacuaugucguauggguaaagcgcuuauuuaucggacuucgguccgauaaauaagaagcaucaaag

SEQ ID NO: 2124 - RNA, 105 nt, Artificial Sequence
  gNA Variant Scaffold
uacuggcgcuuuuaucucauuacuuugagagccaucaccagcgacuaugucguauggguaaagcgcuuauuuaucgagaaauccgauaaauaagaagcaucaaag

SEQ ID NO: 2125 - RNA, 103 nt, Artificial Sequence
  gNA Variant Scaffold
gcgcuuuuaucucauuacuuugagagccaucaccagcgacuaugucguauggguaaagcgcuuauuuaucggagagaaauccgauaaauaagaagcaucaaag

SEQ ID NO: 2126 - RNA, 103 nt, Artificial Sequence
  gNA Variant Scaffold
uacuggcgcuuuuaucucauuacuuugagagccaucaccagcgacuaugucguauggguaaagcgcuuauuuaucggagagagauaaauaagaagcaucaaag

SEQ ID NO: 2127 - RNA, 108 nt, Artificial Sequence
  gNA Variant Scaffold
uacuggcgcuuuuaucucauuacuuuggagagccaucaccagcgacuaugucguauggguaaagcgcuuauuuaucggagaguauccgauaaauaagaagcaucaaag

SEQ ID NO: 2128 - RNA, 109 nt, Artificial Sequence
  gNA Variant Scaffold
uacuggcgcuuuuaucucauuacuuugagagccaucaccagcgacuauguucguauggguaaagcgcuuauuuaucggagagaaauccgauaaauaagaagcaucaaag

SEQ ID NO: 2129 - RNA, 105 nt, Artificial Sequence
  gNA Variant Scaffold
agcgcuuuuaucucauuacuuugagagccaucaccagcgacuaugucguauggguaaagcgcuuauuuaucggagagaaaugccgauaaauaagaagcaucaaag

SEQ ID NO: 2130 - RNA, 109 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaauaagaagcaucaaag

SEQ ID NO: 2131 - RNA, 109 nt, Artificial Sequence
  gNA Variant Scaffold
uacuggcgcuuuuaucucauuacuuugagagccaucaccagcgacuaugucguauggguaaagcgcuuauuguaucggagagaaauccgauaaauaagaagcaucaaag

SEQ ID NO: 2132 - RNA, 102 nt, Artificial Sequence
  gNA Variant Scaffold
gcgcuuuuaucucauuacuuugagagccaucaccagcgacuaugucguauggguaaagcgcuuauuuaucggacuucgguccgauaaauaagcgcaucaaag

SEQ ID NO: 2133 - RNA, 108 nt, Artificial Sequence
  gNA Variant Scaffold
uacuggcgcuuuucucucauuacuuugagagccaucaccagcgacuaugucguauggguaaagcgcuuauuuaucggagagaaauccgauaaauaagaagcaucaaag

SEQ ID NO: 2134 - RNA, 106 nt, Artificial Sequence
  gNA Variant Scaffold
guggcgcuuuuaucucauuacuuugagagccaucaccagcgacuaugucguauggguaaagcgcuuauuuaucggagagaaauccgauaaauaagaagcaucaaag

SEQ ID NO: 2135 - RNA, 110 nt, Artificial Sequence
  gNA Variant Scaffold
uacuggcgcuuuuaucucauuacuuugagagccaucaccagcgaccuuaugucguauggguaaagcgcuuauuuaucggagagaaauccgauaaauaagaagcaucaaag

SEQ ID NO: 2136 - RNA, 107 nt, Artificial Sequence
  gNA Variant Scaffold
gauggcgcuuuuaucucauuacuuugagagccaucaccagcgacuaugucguauggguaaagcgcuuauuuaucggacuucgguccgauaaauaagaagcaucaaag

SEQ ID NO: 2137 - RNA, 106 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaagaagcaucaaag

SEQ ID NO: 2138 - RNA, 109 nt, Artificial Sequence
  gNA Variant Scaffold
uacuggcgcuuuuaucucauuacuuugagagccaucaccagcgaucuaugucguauggguaaagcgcuuauuuaucggagagaaauccgauaaauaagaagcaucaaag

SEQ ID NO: 2139 - RNA, 106 nt, Artificial Sequence
  gNA Variant Scaffold
uacuggcgcuuuuaucucauuacuuugagagccaucaccagcgacuaugucguauggguaaaggcuuauuuaucggagagaaauccgauaaaaagaagcaucaaag

SEQ ID NO: 2140 - RNA, 107 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaaagaagcaucaaag

SEQ ID NO: 2141 - RNA, 107 nt, Artificial Sequence
  gNA Variant Scaffold
uacuggcgcuuuaucucauuacuuugagagccaucaccagcgacuaugucguauggguaaagcgcuuauuuaucggacuucgguccgauaaauaagaagcaucaaag

SEQ ID NO: 2142 - RNA, 98 nt, Artificial Sequence
  gNA Variant Scaffold
cggcgcuuuucucgcauuacuuugagagccaucaccagcgacuaugucguauggguaaagcgcuuauuguaucgagagauaaauaagaagcaucaaag

SEQ ID NO: 2143 - RNA, 107 nt, Artificial Sequence
  gNA Variant Scaffold
cacuggcgcuuuuaucucauuacuuugagagccaucaccagcgacuaugucguauggguaaagcgcuuauuuucggagagaaauccgauaaauaagaagcaucaaag

SEQ ID NO: 2144 - RNA, 106 nt, Artificial Sequence
  gNA Variant Scaffold
uacuggcgcuuuaucucauuacuuugagagccaucaccagcgacuucggucguauggguaaagcgcuuauguaucggcuucggccgauacauaagaagcaucaaag

SEQ ID NO: 2145 - RNA, 107 nt, Artificial Sequence
  gNA Variant Scaffold
uacuggcgcuuuuaucucauuacuuugagagccaucaccagcgacuucggucguauggguaaagcgcuuauguaucggcuucggccgauacauaagaagcaucaaag

SEQ ID NO: 2146 - RNA, 109 nt, Artificial Sequence
  gNA Variant Scaffold
uacuggcgcuuuuaucucauuacuuugagagccaucaccagcgacuaugucguaugggugaaagcgcuuauuuaucggagagaaauccgauaaauaagaagcaucaaag

SEQ ID NO: 2147 - RNA, 64 nt, Artificial Sequence
  gNA Variant Scaffold
uacuggcgcuuuuaucucauuacuuugagagccaucaccagcgacuucggucguauggguaaag

SEQ ID NO: 2148 - RNA, 62 nt, Artificial Sequence
  gNA Variant Scaffold
gaugggcuuuuaucucauuacuuugagagccaucaccagcgacuucggucguauggguaaag

SEQ ID NO: 2149 - RNA, 105 nt, Artificial Sequence
  gNA Variant Scaffold
gaugggcuuuuaucucauuacuuugagagccaucaccagcgacuucggucguauggguaaagcgcuuauuuaucggcuucggccgauaaauaagaagcaucaaag

SEQ ID NO: 2150 - RNA, 156 nt, Artificial Sequence
  gNA Variant Scaffold
uacuggcgcuuuuaucucauuacuuugagagccaucaccagcgacuaugucguauggguaaagcgcuacacugggaucgcugaauuagagaucggcguccuuucauucuauauacuuuggaguuuuaaaaugucucuaaguacagaagcaucaaag

SEQ ID NO: 2151 - RNA, 103 nt, Artificial Sequence
  gNA Variant Scaffold
ggcgcuuuuaucucauuacuuugagagccaucaccagcgacuucggucguauggguaaagcgcuuauuuaucggcuucggccgauaaauaagaagcaucaaag

SEQ ID NO: 2152 - RNA, 106 nt, Artificial Sequence
  gNA Variant Scaffold
gcuggcgcuuuuaucucauuacuuugagagccaucaccagcgacuucggucguauggguaaagcgcuuauuuaucggcuucggccgauaaauaagaagcaucaaag

SEQ ID NO: 2153 - RNA, 109 nt, Artificial Sequence
  gNA Variant Scaffold
uacuggcgcuuuuaucucauuacuuugagagccaucaccagcgacuucggucguauggguaaagcgcuuauuuaucggagagaaauccgauaaauaagaagcaucaaag

SEQ ID NO: 2154 - RNA, 112 nt, Artificial Sequence
  gNA Variant Scaffold
uacuggcgcuuuuaucucauuacuuugagagccaugcuccaccagcgacuaugucguauggguaaagcgcuuauuuaucggagagaaauccgauaaauaagaagcaucaaag

SEQ ID NO: 2155 - RNA, 97 nt, Artificial Sequence
  gNA Variant Scaffold
uacuggcgcuuuuaucucauuacuuugagagccaucaccagcgacuaugucguauggguaaagcgggguuaggguuaggguuagggaagcaucaaag

SEQ ID NO: 2156 - RNA, 96 nt, Artificial Sequence
  gNA Variant Scaffold
uacuggcgcuuuuaucucauuacuuugagagccaucaccagcgacuaugucguauggguaaagcggagggagggagggagagggaaagcaucaaag

SEQ ID NO: 2157 - RNA, 101 nt, Artificial Sequence
  gNA Variant Scaffold
uacuggcgcuuuuaucucauuacuuugagagccaucaccagcgacuaugucguauggguaaagcguuggguuaggguuaggguuagggaaaagcaucaaag

SEQ ID NO: 2158 - RNA, 91 nt, Artificial Sequence
  gNA Variant Scaffold
uacuggcgcuuuuaucucauuacuuugagagccaucaccagcgacuaugucguauggguaaagcgcagggcuucggccggaagcaucaaag

SEQ ID NO: 2159 - RNA, 103 nt, Artificial Sequence
  gNA Variant Scaffold
uacuggcgcuuuuaucucauuacuuugagagccaucaccagcgacuaugucguauggguaaagcgccugcucaguacgagaggaaccgcaggaagcaucaaag

SEQ ID NO: 2160 - RNA, 90 nt, Artificial Sequence
  gNA Variant Scaffold
uacuggcgcuuuuaucugauuacuuugagagccaucaccagcgacuaugucguauggguaaagcgcccucuucggagggaagcaucaaag

SEQ ID NO: 2161 - RNA, 98 nt, Artificial Sequence
  gNA Variant Scaffold
uacuggcgccuuuaucugauuacuuugagagccaucaccagcgacuaugucguauggguaaagcgcuuacggacuucgguccguaagaagcaucaaag

SEQ ID NO: 2162 - RNA, 98 nt, Artificial Sequence
  gNA Variant Scaffold
uacuggcgcuuuuaucugauuacuuugagagccaucaccagcgacuaugucguauggguaaagcgcggacgaccucucggucguccgaagcaucaaag

SEQ ID NO: 2163 - RNA, 108 nt, Artificial Sequence
  gNA Variant Scaffold
uacuggcgcuuuuaucugauuacuuugagagccaucaccagcgacuaugucguauggguaaagcgcaggugggacgaccucucggucguccuaucugaagcaucaaag

SEQ ID NO: 2164 - RNA, 99 nt, Artificial Sequence
  gNA Variant Scaffold
uacuggcgccuuuaucugcauuacuuugagagccaucaccagcgacuaugucguauggguaaagcgcuuacggacuucgguccguaagaagcaucaaag

SEQ ID NO: 2165 - RNA, 97 nt, Artificial Sequence
  gNA Variant Scaffold
gcuggcgcuuuuaucugauuacuuugagagccaucaccagcgacuaugucguauggguaaagcgcuuacggacuucgguccguaagaagcaucaaag

SEQ ID NO: 2166 - RNA, 108 nt, Artificial Sequence
  gNA Variant Scaffold
uacuggcgccuuuaucugauuacuuugagagccaucaccagcgacuaugucguauggguaaagcgcaggugggacgaccucucggucguccuaucugaagcaucaaag

SEQ ID NO: 2167 - RNA, 98 nt, Artificial Sequence
  gNA Variant Scaffold
uacuggcgccuuuaucugauuacuuugagagccaucaccagcgacuaugucguauggguaaagcgcggacgaccucucggucguccgaagcaucaaag

SEQ ID NO: 2168 - RNA, 90 nt, Artificial Sequence
  gNA Variant Scaffold
uacuggcgccuuuaucucauuacuuugagagccaucaccagcgacuaugucguauggguaaagcgcccucuucggagggaagcaucaaag

SEQ ID NO: 2169 - RNA, 98 nt, Artificial Sequence
  gNA Variant Scaffold
uacuggcgcuuuuaucucauuacuuugagagccaucaccagcgacuaugucguauggguaaagcgcuuacggacuucgguccguaagaagcaucaaag

SEQ ID NO: 2170 - RNA, 99 nt, Artificial Sequence
  gNA Variant Scaffold
uacuggcgccuuuaucaucauuacuuugagagccaucaccagcgacuaugucguauggguaaagcgcuuacggacuucgguccguaagaagcaucaaag

SEQ ID NO: 2171 - RNA, 194 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagggccggcauggucccagccuccucgcuggcgccggcugggcaacauuccgaggggaccguccccucgguaauggcgaaugggaccc

SEQ ID NO: 2172 - RNA, 108 nt, Artificial Sequence
  gNA Variant Scaffold
uacuggcgccuuuaucucauuacuuugagagccaucaccagcgacuaugucguauggguaaagcgcaggugggacgaccucucggucguccuaucugaagcaucaaag

SEQ ID NO: 2173 - RNA, 106 nt, Artificial Sequence
  gNA Variant Scaffold
uacuggcgcuuuuaucucauuacuuugagagccaucaccagcgacuaugucguauggguaaagcgcuuauuuaucggagaaauccgauaaauaagaagcaucaaag

SEQ ID NO: 2174 - RNA, 98 nt, Artificial Sequence
  gNA Variant Scaffold
uacuggcgccuuuaucucauuacuuugagagccaucaccagcgacuaugucguauggguaaagcgcggacgaccucucggucguccgaagcaucaaag

SEQ ID NO: 2175 - RNA, 92 nt, Artificial Sequence
  gNA Variant Scaffold
uacuggcgcuuuuaucucauuacuuugagagccaucaccagcgacuaugucguauggguaaagcgccggacuucgguccggaagcaucaaag

SEQ ID NO: 2176 - RNA, 108 nt, Artificial Sequence
  gNA Variant Scaffold
uacuggcgcuuuuaucggauuacuuugagagccaucaccagcgacuaugucguauggguaaagcgcuuauuuaucggagagaaauccgauaaauaagaagcaucaaag

SEQ ID NO: 2177 - RNA, 98 nt, Artificial Sequence
  gNA Variant Scaffold
uacuggcgcuuuuaucucauuacuuugagagccaucaccagcgacuaugucguauggguaaagcgcggacgaccucucggucguccgaagcaucaaag

SEQ ID NO: 2178 - RNA, 89 nt, Artificial Sequence
  gNA Variant Scaffold
gcuggcgcuuuuaucugauuacuuugagagccaucaccagcgacuaugucguauggguaaagcgcccucuucggagggaagcaucaaag

SEQ ID NO: 2179 - RNA, 88 nt, Artificial Sequence
  gNA Variant Scaffold
gcuggcgccuuuaucugauuacuuugagagccaucaccagcgacuaugucguauggguaaagcucccucuucggagggagcaucaaag

SEQ ID NO: 2180 - RNA, 197 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggggucggcauggcaucuccaccuccucgcgguccgaccugggcauccgaaggaggacgcacguccacucggauggcuaagggagagcca

SEQ ID NO: 2181 - RNA, 88 nt, Artificial Sequence
  gNA Variant Scaffold
gcuggcgccuuuaucugauuacuuugagagccaucaccagcgacuaugucguauggguaaagcgcccucuucggagggcgcaucaaag

SEQ ID NO: 2182 - RNA, 186 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaguuuuggccggcauggucccagccuccucgcuggcgccggcugggcaacaugcuucggcauggcgaaugggaccccggg

SEQ ID NO: 2183 - RNA, 97 nt, Artificial Sequence
  gNA Variant Scaffold
gauggcgccuuuaucucauuacuuugagagccaucaccagcgacuaugucguauggguaaagcgcuuacggacuucgguccguaagaagcaucaaag

SEQ ID NO: 2184 - RNA, 89 nt, Artificial Sequence
  gNA Variant Scaffold
gcuggcgcuuuuaucucauuacuuugagagccaucaccagcgacuaugucguauggguaaagcgcccucuucggagggaagcaucaaag

SEQ ID NO: 2185 - RNA, 96 nt, Artificial Sequence
  gNA Variant Scaffold
gcuggcgccuuuaucugauuacuuugagagccaucaccagcgacuaugucguauggguaaagcucuuacggacuucgguccguaagagcaucaaag

SEQ ID NO: 2186 - RNA, 96 nt, Artificial Sequence
  gNA Variant Scaffold
gcuggcgccuuuaucugauuacuuugagagccaucaccagcgacuaugucguauggguaaagcucggacgaccucucggucguccgagcaucaaag

SEQ ID NO: 2187 - RNA, 160 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagccugucaccggaugugcuuuccggucugaugaguccgugaggacgaaacagg

SEQ ID NO: 2188 - RNA, 97 nt, Artificial Sequence
  gNA Variant Scaffold
gcuggcgcuuuuaucugauuacuuugagagccaucaccagcgacuaugucguauggguaaagcgcggacgaccucucggucguccgaagcaucaaag

SEQ ID NO: 2189 - RNA, 97 nt, Artificial Sequence
  gNA Variant Scaffold
gcuggcgccuuuaucugauuacuuugagagccaucaccagcgacuaugucguauggguaaagcgcggacgaccucucggucguccgaagcaucaaag

SEQ ID NO: 2190 - RNA, 106 nt, Artificial Sequence
  gNA Variant Scaffold
gcuggcgccuuuaucugauuacuuugagagccaucaccagcgacuaugucguauggguaaagcucaggugggacgaccucucggucguccuaucugagcaucaaag

SEQ ID NO: 2191 - RNA, 177 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggauggccggcauggucccagccuccucgcuggcgccggcugggcaacaccuucggguggcgaaugggac

SEQ ID NO: 2192 - RNA, 107 nt, Artificial Sequence
  gNA Variant Scaffold
gcuggcgcuuuuaucugauuacuuugagagccaucaccagcgacuaugucguauggguaaagcgcaggugggacgaccucucggucguccuaucugaagcaucaaag

SEQ ID NO: 2193 - RNA, 109 nt, Artificial Sequence
  gNA Variant Scaffold
uacuggcgcuuuuaucucauuacuuugagagccaucaccagcgacuaugucguacuggguaaagcgcuuauuuaucggagagaaauccgauaaauaagaagcaucaaag

SEQ ID NO: 2194 - RNA, 107 nt, Artificial Sequence
  gNA Variant Scaffold
uacuggcgcuuuuaucucauuacuuugagagccaucaccagcgacuaugucguauggguaaagcgcuuauuuaucgugagaaauccgauaaauaagaagcaucaaag

SEQ ID NO: 2195 - RNA, 109 nt, Artificial Sequence
  gNA Variant Scaffold
guacuggcgcuuuuaucucauuacuuugagagccaucaccagcgacuaugucguauggguaaagcgcuuauuuaucggagagaaauccgauaaauaagaagcaucaaag

SEQ ID NO: 2196 - RNA, 97 nt, Artificial Sequence
  gNA Variant Scaffold
gcuggcgcuuuuaucucauuacuuugagagccaucaccagcgacuaugucguauggguaaagcgcggacgaccucucggucguccgaagcaucaaag

SEQ ID NO: 2197 - RNA, 97 nt, Artificial Sequence
  gNA Variant Scaffold
gcuggcgccuuuaucugauuacuuugagagccaucaccagcgacuaugucguauggguaaagcgcuuacggacuucgguccguaagaagcaucaaag

SEQ ID NO: 2198 - RNA, 107 nt, Artificial Sequence
  gNA Variant Scaffold
gcuggcgcuuuuaucucauuacuuugagagccaucaccagcgacuaugucguauggguaaagcgcuuauuuaucggagagaaauccgauaaauaagaagcaucaaag

SEQ ID NO: 2199 - RNA, 97 nt, Artificial Sequence
  gNA Variant Scaffold
gcuggcgccuuuaucucauuacuuugagagccaucaccagcgacuaugucguauggguaaagcgcuuacggacuucgguccguaagaagcaucaaag

SEQ ID NO: 2200 - RNA, 89 nt, Artificial Sequence
  gNA Variant Scaffold
gcuggcgccuuuaucugauuacuuugagagccaucaccagcgacuaugucguauggguaaagcgcccucuucggagggaagcaucaaag

SEQ ID NO: 2201 - RNA, 107 nt, Artificial Sequence
  gNA Variant Scaffold
gcuggcgcuuuuaucucauuacuuugagagccaucaccagcgacuaugucguauggguaaagcgcaggugggacgaccucucggucguccuaucugaagcaucaaag

SEQ ID NO: 2202 - RNA, 107 nt, Artificial Sequence
  gNA Variant Scaffold
gcuggcgccuuuaucucauuacuuugagagccaucaccagcgacuaugucguauggguaaagcgcaggugggacgaccucucggucguccuaucugaagcaucaaag

SEQ ID NO: 2203 - RNA, 107 nt, Artificial Sequence
  gNA Variant Scaffold
gcuggcgccuuuaucugauuacuuugagagccaucaccagcgacuaugucguauggguaaagcgcaggugggacgaccucucggucguccuaucugaagcaucaaag

SEQ ID NO: 2204 - RNA, 98 nt, Artificial Sequence
  gNA Variant Scaffold
uacuggcgcuuuuaucugauuacuuugagagccaucaccagcgacuaugucguauggguaaagcgcuuacggacuucgguccguaagaagcaucaaag

SEQ ID NO: 2205 - RNA, 89 nt, Artificial Sequence
  gNA Variant Scaffold
gcuggcgccuuuaucucauuacuuugagagccaucaccagcgacuaugucguauggguaaagcgcccucuucggagggaagcaucaaag

SEQ ID NO: 2206 - RNA, 97 nt, Artificial Sequence
  gNA Variant Scaffold
gcuggcgcuuuuaucucauuacuuugagagccaucaccagcgacuaugucguauggguaaagcgcuuacggacuucgguccguaagaagcaucaaag

SEQ ID NO: 2207 - RNA, 97 nt, Artificial Sequence
  gNA Variant Scaffold
gcuggcgccuuuaucucauuacuuugagagccaucaccagcgacuaugucguauggguaaagcgcggacgaccucucggucguccgaagcaucaaag

SEQ ID NO: 2208 - RNA, 177 nt, Artificial Sequence
  gNA Variant Scaffold
gauggccggcauggucccagccuccucgcuggcgccggcugggcaacaccuucggguggcgaaugggacuacuggcgcuuuuaucucauuacuuugagagccaucaccagcgacuaugucguauggguaaagcgcuuauuuaucggagagaaauccgauaaauaagaagcaucaaag

SEQ ID NO: 2209 - RNA, 194 nt, Artificial Sequence
  gNA Variant Scaffold
ggccggcauggucccagccuccucgcuggcgccggcugggcaacauuccgaggggaccguccccucgguaauggcgaaugggacccuacuggcgcuuuuaucucauuacuuugagagccaucaccagcgacuaugucguauggguaaagcgcuuauuuaucggagagaaauccgauaaauaagaagcaucaaag

SEQ ID NO: 2210 - RNA, 96 nt, Artificial Sequence
  gNA Variant Scaffold
gcuggcgccuuuaucugauuacuuugagagccaucaccagcgacuaugucguauggguaaagcgcuuacggacuucgguccguaagcgcaucaaag

SEQ ID NO: 2211 - RNA, 172 nt, Artificial Sequence
  gNA Variant Scaffold
cgugguuagggccacguuaaauaguugcuuaagcccuaagcguugaucuucggaucaggugcaauacuggcgcuuuuaucucauuacuuugagagccaucaccagcgacuaugucguauggguaaagcgcuuauuuaucggagagaaauccgauaaauaagaagcaucaaag

SEQ ID NO: 2212 - RNA, 197 nt, Artificial Sequence
  gNA Variant Scaffold
gggucggcauggcaucuccaccuccucgcgguccgaccugggcauccgaaggaggacgcacguccacucggauggcuaagggagagccauacuggcgcuuuuaucucauuacuuugagagccaucaccagcgacuaugucguauggguaaagcgcuuauuuaucggagagaaauccgauaaauaagaagcaucaaag

SEQ ID NO: 2213 - RNA, 171 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagccaguacugaugaguccgugaggacgaaacgaguaagcucgucuacuggcgcuuuuaucucau

SEQ ID NO: 2214 - RNA, 99 nt, Artificial Sequence
  gNA Variant Scaffold
uacuggcgccuuuaucucauuacuuuagagagccaucaccagcgacuaugucguauggguaaagcgcuuacggacuucgguccguaagaagcaucaaag

SEQ ID NO: 2215 - RNA, 157 nt, Artificial Sequence
  gNA Variant Scaffold
cgacuacugaugaguccgugaggacgaaacgaguaagcucgucuagucguacuggcgcuuuuaucucauuacuuugagagccaucaccagcgacuaugucguauggguaaagcgcuuauuuaucggagagaaauccgauaaauaagaagcaucaaag

SEQ ID NO: 2216 - RNA, 106 nt, Artificial Sequence
  gNA Variant Scaffold
gcuggcgccuuuaucugauuacuuugagagccaucaccagcgacuaugucguauggguaaagcgcaggugggacgaccucucggucguccuaucugcgcaucaaag

SEQ ID NO: 2217 - RNA, 97 nt, Artificial Sequence
  gNA Variant Scaffold
uacuggcgccuuuaucucauuacuuuagagccaucaccagcgacuaugucguauggguaaagcgcuuacggacuucgguccguaagaagcaucaaag

SEQ ID NO: 2218 - RNA, 186 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcauuccucagaaaaugacaaaccuguggggcguaaguagaucuucggaucuaugaucgugcagacguuaaaaucaggu

SEQ ID NO: 2219 - RNA, 171 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucgcguguagcgaagca

SEQ ID NO: 2220 - RNA, 186 nt, Artificial Sequence
  gNA Variant Scaffold
cauuccucagaaaaugacaaaccuguggggcguaaguagaucuucggaucuaugaucgugcagacguuaaaaucagguuacuggcgcuuuuaucucauuacuuugagagccaucaccagcgacuaugucguauggguaaagcgcuuauuuaucggagagaaauccgauaaauaagaagcaucaaag

SEQ ID NO: 2221 - RNA, 186 nt, Artificial Sequence
  gNA Variant Scaffold
uuuuggccggcauggucccagccuccucgcuggcgccggcugggcaacaugcuucggcauggcgaaugggaccccggguacuggcgcuuuuaucucauuacuuugagagccaucaccagcgacuaugucguauggguaaagcgcuuauuuaucggagagaaauccgauaaauaagaagcaucaaag

SEQ ID NO: 2222 - RNA, 171 nt, Artificial Sequence
  gNA Variant Scaffold
cgacuacugaugaguccgugaggacgaaacgaguaagcucgucuagucgcguguagcgaagcauacuggcgcuuuuaucucauuacuuugagagccaucaccagcgacuaugucguauggguaaagcgcuuauuuaucggagagaaauccgauaaauaagaagcaucaaag

SEQ ID NO: 2223 - RNA, 168 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggggagccccgcugaugaggucggggagaccgaaagggacuucggucccuacggggcuccc

SEQ ID NO: 2224 - RNA, 144 nt, Artificial Sequence
  gNA Variant Scaffold
ccacccccaccaccacccccacccccaccaccacccuacuggcgcuuuuaucucauuacuuugagagccaucaccagcgacuaugucguauggguaaagcgcuuauuuaucggagagaaauccgauaaauaagaagcaucaaag

SEQ ID NO: 2225 - RNA, 157 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucg

SEQ ID NO: 2226 - RNA, 172 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgugguuagggccacguuaaauaguugcuuaagcccuaagcguugaucuucggaucaggugcaa

SEQ ID NO: 2227 - RNA, 184 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagggcaauaaagcgguuacaagcccgcaaaaauagcagaguaaugucgcgauagcgcggcauuaaugcagcuuuauug

SEQ ID NO: 2228 - RNA, 122 nt, Artificial Sequence
  gNA Variant Scaffold
uacuggcgcuuuuaucucauuacuauuaucucauuacuuugagagccaucaccagcgacuaugucguauggguaaagcgcuuauuuaucggagagaaauccgauaaauaagaagcaucaaag

SEQ ID NO: 2229 - RNA, 184 nt, Artificial Sequence
  gNA Variant Scaffold
ggcaauaaagcgguuacaagcccgcaaaaauagcagaguaaugucgcgauagcgcggcauuaaugcagcuuuauuguacuggcgcuuuuaucucauuacuuugagagccaucaccagcgacuaugucguauggguaaagcgcuuauuuaucggagagaaauccgauaaauaagaagcaucaaag

SEQ ID NO: 2230 - RNA, 185 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagacccgcaaggccgacggcauccgccgccgcuggugcaaguccagccgccccuucgggggcgggcgcucauggguaac

SEQ ID NO: 2231 - RNA, 63 nt, Artificial Sequence
  gNA Variant Scaffold
uacuggcgcuuuuaucucauuacuuugagagccaucaccagcgacuaugucguauggguaaag

SEQ ID NO: 2232 - RNA, 168 nt, Artificial Sequence
  gNA Variant Scaffold
gggagccccgcugaugaggucggggagaccgaaagggacuucggucccuacggggcucccuacuggcgcuuuuaucucauuacuuugagagccaucaccagcgacuaugucguauggguaaagcgcuuauuuaucggagagaaauccgauaaauaagaagcaucaaag

SEQ ID NO: 2233 - RNA, 171 nt, Artificial Sequence
  gNA Variant Scaffold
ccaguacugaugaguccgugaggacgaaacgaguaagcucgucuacuggcgcuuuuaucucauuacuggcgcuuuuaucucauuacuuugagagccaucaccagcgacuaugucguauggguaaagcgcuuauuuaucggagagaaauccgauaaauaagaagcaucaaag

SEQ ID NO: 2234 - RNA, 185 nt, Artificial Sequence
  gNA Variant Scaffold
acccgcaaggccgacggcauccgccgccgcuggugcaaguccagccgccccuucgggggcgggcgcucauggguaacuacuggcgcuuuuaucucauuacuuugagagccaucaccagcgacuaugucguauggguaaagcgcuuauuuaucggagagaaauccgauaaauaagaagcaucaaag

SEQ ID NO: 2235 - RNA, 160 nt, Artificial Sequence
  gNA Variant Scaffold
ccugucaccggaugugcuuuccggucugaugaguccgugaggacgaaacagguacuggcgcuuuuaucucauuacuuugagagccaucaccagcgacuaugucguauggguaaagcgcuuauuuaucggagagaaauccgauaaauaagaagcaucaaag

SEQ ID NO: 2236 - RNA, 100 nt, Artificial Sequence
  gNA Variant Scaffold
guacuggcgccuuuaucucauuacuuugagagccaucaccagcgacuaugucguaguggguaaagcgcuuacggacuucgguccguaagaagcaucaaag

SEQ ID NO: 2237 - RNA, 91 nt, Artificial Sequence
  gNA Variant Scaffold
guacuggcgcuuuuaucugauuacuuugagagccaucaccagcgacuaugucguaguggguaaagcucccucuucggagggagcaucaaag

SEQ ID NO: 2238 - RNA, 89 nt, Artificial Sequence
  gNA Variant Scaffold
acuggcgcuuuuaucugauuacuuugagagccaucaccagcgacuaugucguaguggguaaagcucccucuucggagggagcaucaaag

SEQ ID NO: 2239 - RNA, 97 nt, Artificial Sequence
  gNA Variant Scaffold
acuggcgccuuuaucucauuacuuugagagccaucaccagcgacuaugucguauggguaaagcgcuuacggacuucgguccguaagaagcaucaaag

SEQ ID NO: 2240 - RNA, 89 nt, Artificial Sequence
  gNA Variant Scaffold
gcuggcgcuuuuaucugauuacuuugagagccaucaccagcgacuaugucguaguggguaaagcucccucuucggagggagcaucaaag

SEQ ID NO: 2241 - RNA, 88 nt, Artificial Sequence
  gNA Variant Scaffold
acuggcgcuuuuaucugauuacuuugagagccaucaccagcgacuaugucguauggguaaagcucccucuucggagggagcaucaaag

SEQ ID NO: 2242 - RNA, 97 nt, Artificial Sequence
  gNA Variant Scaffold
acuggcgccuuuaucugauuacuuugagagccaucaccagcgacuaugucguauggguaaagcgcuuacggacuucgguccguaagaagcaucaaag

SEQ ID NO: 2243 - RNA, 97 nt, Artificial Sequence
  gNA Variant Scaffold
acuggcgcuuuuaucugauuacuuugagagccaucaccagcgacuaugucguauggguaaagcgcuuacggacuucgguccguaagaagcaucaaag

SEQ ID NO: 2244 - RNA, 98 nt, Artificial Sequence
  gNA Variant Scaffold
acuggcgcuuuuaucugauuacuuugagagccaucaccagcgacuaugucguaguggguaaagcgcuuacggacuucgguccguaagaagcaucaaag

SEQ ID NO: 2245 - RNA, 89 nt, Artificial Sequence
  gNA Variant Scaffold
acuggcgcuuuuaucugauuacuuugagagccaucaccagcgacuaugucguauuggguaaagcucccucuucggagggagcaucaaag

SEQ ID NO: 2246 - RNA, 98 nt, Artificial Sequence
  gNA Variant Scaffold
acuggcgcuuuuaucugauuacuuugagagccaucaccagcgacuaugucguauuggguaaagcgcuuacggacuucgguccguaagaagcaucaaag

SEQ ID NO: 2247 - RNA, 98 nt, Artificial Sequence
  gNA Variant Scaffold
acuggcgccuuuaucaucauuacuuugagagccaucaccagcgacuaugucguauggguaaagcgcuuacggacuucgguccguaagaagcaucaaag

SEQ ID NO: 2248 - RNA, 90 nt, Artificial Sequence
  gNA Variant Scaffold
acuggcgcuuuuaucugauuacuuugagagccaucaccagcgacuaugucguaguggguaaagcgcccucuucggagggaagcaucaaag

SEQ ID NO: 2249 - RNA, 96 nt, Artificial Sequence
  gNA Variant Scaffold
acuggcgcuuuuaucugauuacuuugagagccaucaccagcgacuaugucguaguggguaaagcucacaugaggaucacccaugugagcaucaaag

SEQ ID NO: 2250 - RNA, 89 nt, Artificial Sequence
  gNA Variant Scaffold
acuggcacuuuuaccugauuacuuugagagccaacaccagcgacuaugucguaguggguaaagcucccucuucggagggagcaucaaag

SEQ ID NO: 2251 - RNA, 89 nt, Artificial Sequence
  gNA Variant Scaffold
acuggcacuuuuaucugauuacuuugagagccaucaccagcgacuaugucguaguggguaaagcucccucuucggagggagcaucaaag

SEQ ID NO: 2252 - RNA, 89 nt, Artificial Sequence
  gNA Variant Scaffold
acuggcccuuuuaucugauuacuuugagagccaucaccagcgacuaugucguaguggguaaagcucccucuucggagggagcaucaaag

SEQ ID NO: 2253 - RNA, 89 nt, Artificial Sequence
  gNA Variant Scaffold
acuggcgcuuuuaccugauuacuuugagagccaucaccagcgacuaugucguaguggguaaagcucccucuucggagggagcaucaaag

SEQ ID NO: 2254 - RNA, 89 nt, Artificial Sequence
  gNA Variant Scaffold
acuggcgcuuuuaucugauuacuuugagagccaacaccagcgacuaugucguaguggguaaagcucccucuucggagggagcaucaaag

SEQ ID NO: 2255 - RNA, 97 nt, Artificial Sequence
  gNA Variant Scaffold
acuggcaccuuuaccugauuacuuugagagccaacaccagcgacuaugucguauggguaaagcgcuuacggacuucgguccguaagaagcaucaaag

SEQ ID NO: 2256 - RNA, 97 nt, Artificial Sequence
  gNA Variant Scaffold
acuggcaccuuuaucugauuacuuugagagccaucaccagcgacuaugucguauggguaaagcgcuuacggacuucgguccguaagaagcaucaaag

SEQ ID NO: 2257 - RNA, 97 nt, Artificial Sequence
  gNA Variant Scaffold
acuggccccuuuaucugauuacuuugagagccaucaccagcgacuaugucguauggguaaagcgcuuacggacuucgguccguaagaagcaucaaag

SEQ ID NO: 2258 - RNA, 97 nt, Artificial Sequence
  gNA Variant Scaffold
acuggcgccuuuaucugauuacuuugagagccaacaccagcgacuaugucguauggguaaagcgcuuacggacuucgguccguaagaagcaucaaag

SEQ ID NO: 2259 - RNA, 89 nt, Artificial Sequence; identical to SEQ ID NO: 2240
  gNA Variant Scaffold

SEQ ID NO: 2260 - RNA, 90 nt, Artificial Sequence
  gNA Variant Scaffold
gacuggcgcuuuuaucugauuacuuugagagccaucaccagcgacuaugucguaguggguaaagcucccucuucggagggagcaucaaag

SEQ ID NO: 2261 - RNA, 90 nt, Artificial Sequence
  gNA Variant Scaffold
acuggcgccuuuaucugauuacuuuggagagccaucaccagcgacuaugucguaguggguaaagcucccucuucggagggagcaucaaag

SEQ ID NO: 2262 - RNA, 89 nt, Artificial Sequence
  gNA Variant Scaffold
acuggcgcauuuaucugauuacuuugugagccaucaccagcgacuaugucguaguggguaaagcucccucuucggagggagcaucaaag

SEQ ID NO: 2263 - RNA, 89 nt, Artificial Sequence
  gNA Variant Scaffold
acuggcgccuuuaucugauuacuuugagagccaucaccagcgacuaugucguaguggguaaagcucccucuucggagggagcaucaaag

SEQ ID NO: 2264 - RNA, 90 nt, Artificial Sequence
  gNA Variant Scaffold
acuggcgcuuuuaucugauuacuuuggagagccaucaccagcgacuaugucguaguggguaaagcucccucuucggagggagcaucaaag

SEQ ID NO: 2265 - RNA, 89 nt, Artificial Sequence
  gNA Variant Scaffold
acuggcgcauuuaucugauuacuuugagagccaucaccagcgacuaugucguaguggguaaagcucccucuucggagggagcaucaaag

SEQ ID NO: 2266 - RNA, 89 nt, Artificial Sequence
  gNA Variant Scaffold
acuggcgcuuuuaucugauuacuuugugagccaucaccagcgacuaugucguaguggguaaagcucccucuucggagggagcaucaaag

SEQ ID NO: 2267 - RNA, 90 nt, Artificial Sequence
  gNA Variant Scaffold
acuggcgcuuuuauucugauuacuuugagagccaucaccagcgacuaugucguaguggguaaagcucccucuucggagggagcaucaaag

SEQ ID NO: 2268 - RNA, 88 nt, Artificial Sequence
  gNA Variant Scaffold
acggcgcuuuuaucugauuacuuugagagccaucaccagcgacuaugucguaguggguaaagcucccucuucggagggagcaucaaag

SEQ ID NO: 2269 - RNA, 89 nt, Artificial Sequence
  gNA Variant Scaffold
acuggcgcuuuuauaugauuacuuugagagccaucaccagcgacuaugucguaguggguaaagcucccucuucggagggagcaucaaag

SEQ ID NO: 2270 - RNA, 90 nt, Artificial Sequence
  gNA Variant Scaffold
acuggcgcuuuuaucuugauuacuuugagagccaucaccagcgacuaugucguaguggguaaagcucccucuucggagggagcaucaaag

SEQ ID NO: 2271 - RNA, 89 nt, Artificial Sequence
  gNA Variant Scaffold
acuggcgcuuuuaucugauuacuuugagagccagcaccagcgacuaugucguaguggguaaagcucccucuucggagggagcaucaaag

SEQ ID NO: 2272 - RNA, 89 nt, Artificial Sequence
  gNA Variant Scaffold
acuggcgcuguuaucugauuacuucgagagccaucaccagcgacuaugucguaguggguaaagcucccucuucggagggagcaucgaag

SEQ ID NO: 2273 - RNA, 89 nt, Artificial Sequence
  gNA Variant Scaffold
acuggcgcucuuaucugauuacuucgagagccaucaccagcgacuaugucguaguggguaaagcucccucuucggagggagcaucgaag

SEQ ID NO: 2274 - RNA, 89 nt, Artificial Sequence
  gNA Variant Scaffold
acuggcgcuuguaucugauuacucugagagccaucaccagcgacuaugucguaguggguaaagcucccucuucggagggagcaucagag

SEQ ID NO: 2275 - RNA, 89 nt, Artificial Sequence
  gNA Variant Scaffold
acuggcgcuucuaucugauuacucugagagccaucaccagcgacuaugucguaguggguaaagcucccucuucggagggagcaucagag

SEQ ID NO: 2276 - RNA, 89 nt, Artificial Sequence
  gNA Variant Scaffold
acuggcgcuuugaucugauuaccuugagagccaucaccagcgacuaugucguaguggguaaagcucccucuucggagggagcaucaagg

SEQ ID NO: 2277 - RNA, 89 nt, Artificial Sequence
  gNA Variant Scaffold
acuggcgcuuucaucugauuaccuugagagccaucaccagcgacuaugucguaguggguaaagcucccucuucggagggagcaucaagg

SEQ ID NO: 2278 - RNA, 89 nt, Artificial Sequence
  gNA Variant Scaffold
acuggcgcuguuaucugauuacuuugagagccaucaccagcgacuaugucguaguggguaaagcucccucuucggagggagcaucaaag

SEQ ID NO: 2279 - RNA, 89 nt, Artificial Sequence
  gNA Variant Scaffold
acuggcgcuuuuaucugauuacuuugagagccaucaccagcgacuaugucguaguggguaaagcucccucuucggagggagcaucgaag

SEQ ID NO: 2280 - RNA, 89 nt, Artificial Sequence
  gNA Variant Scaffold
acuggcgcuuuuaucugauuacuucgagagccaucaccagcgacuaugucguaguggguaaagcucccucuucggagggagcaucaaag

SEQ ID NO: 2281 - DNA, 107 bp, Artificial Sequence; identical to SEQ ID NO: 1136
  scaffold variant

SEQ ID NO: 2282 - DNA, 109 bp, Artificial Sequence; identical to SEQ ID NO: 1055
  scaffold variant

SEQ ID NO: 2283 - DNA, 108 bp, Artificial Sequence
  scaffold variant
tactggcgcttttatctcattactttgagagccatcaccagcgactatgtcgtatgggtaaagcgcttattttcggagagaaatcgcgataaataagaagcatcaaag

SEQ ID NO: 2284 - DNA, 106 bp, Artificial Sequence; identical to SEQ ID NO: 1829
  scaffold variant

SEQ ID NO: 2285 - DNA, 106 bp, Artificial Sequence; identical to SEQ ID NO: 532
  scaffold variant

SEQ ID NO: 2286 - DNA, 109 bp, Artificial Sequence; identical to SEQ ID NO: 1055
  scaffold variant

SEQ ID NO: 2287 - DNA, 107 bp, Artificial Sequence; identical to SEQ ID NO: 1960
  scaffold variant

SEQ ID NO: 2288 - DNA, 107 bp, Artificial Sequence; identical to SEQ ID NO: 1136
  scaffold variant

SEQ ID NO: 2289 - DNA, 107 bp, Artificial Sequence; identical to SEQ ID NO: 878
  scaffold variant

SEQ ID NO: 2290 - DNA, 107 bp, Artificial Sequence; identical to SEQ ID NO: 1736
  scaffold variant

SEQ ID NO: 2291 - DNA, 107 bp, Artificial Sequence; identical to SEQ ID NO: 1972
  scaffold variant

SEQ ID NO: 2292 - DNA, 109 bp, Artificial Sequence; identical to SEQ ID NO: 882
  scaffold variant

SEQ ID NO: 2293 - DNA, 109 bp, Artificial Sequence; identical to SEQ ID NO: 1600
  scaffold variant

SEQ ID NO: 2294 - DNA, 109 bp, Artificial Sequence; identical to SEQ ID NO: 785
  scaffold variant

SEQ ID NO: 2295 - DNA, 109 bp, Artificial Sequence; identical to SEQ ID NO: 785
  scaffold variant

SEQ ID NO: 2296 - DNA, 108 bp, Artificial Sequence
  scaffold variant
tactggcgcttttatctcattactttgagagccatcaccagcgactatgtcgtattgggtaaagcgcttatttatctagagaaatccgataaataagaagcatcaaag

SEQ ID NO: 2297 - DNA, 107 bp, Artificial Sequence; identical to SEQ ID NO: 1307
  scaffold variant

SEQ ID NO: 2298 - DNA, 109 bp, Artificial Sequence
  scaffold variant
tactggcgcttttatctcattactttgagagccatcaccagcgactatgtcgtatgggtaaagcgcttattctatcggagagaaatccgataaataagaagcatcaaag

SEQ ID NO: 2299 - DNA, 109 bp, Artificial Sequence; identical to SEQ ID NO: 1222
  scaffold variant

SEQ ID NO: 2300 - DNA, 107 bp, Artificial Sequence; identical to SEQ ID NO: 1263
  scaffold variant

SEQ ID NO: 2301 - DNA, 106 bp, Artificial Sequence; identical to SEQ ID NO: 782
  scaffold variant

SEQ ID NO: 2302 - DNA, 110 bp, Artificial Sequence
  scaffold variant
ttactggcgcttttatctcattactttgagagccatcaccagcgactatgtcgtatgggtaaagcgcttatttattcggagagaaatccgataaataagaagcatcaaag

SEQ ID NO: 2303 - DNA, 110 bp, Artificial Sequence
  scaffold variant
ctactggcgcttttatctcattactttgagagccatcaccagcgactatgtcgtatgggtaaagcgcttatttatcggagagaaatcgcgataaataagaagcatcaaag

SEQ ID NO: 2304 - DNA, 107 bp, Artificial Sequence; identical to SEQ ID NO: 1017
  scaffold variant

SEQ ID NO: 2305 - DNA, 110 bp, Artificial Sequence
  scaffold variant
tactggcgcttttatctcattactttgagagccatcaccagcgactatgtcgtattgggtaaagcgcttatttatcgggagagaaatccgataaataagaagcatcaaag

SEQ ID NO: 2306 - DNA, 109 bp, Artificial Sequence; identical to SEQ ID NO: 986
  scaffold variant

SEQ ID NO: 2307 - DNA, 108 bp, Artificial Sequence
  scaffold variant
ctactggcgcttttatctcattactttgagagccatcaccagcgactatgtcgtatgggtaaagcgcttatttatcggaagaaatccgataaataagaagcatcaaag

SEQ ID NO: 2308 - DNA, 109 bp, Artificial Sequence; identical to SEQ ID NO: 986
  scaffold variant

SEQ ID NO: 2309 - DNA, 106 bp, Artificial Sequence; identical to SEQ ID NO: 782
  scaffold variant

SEQ ID NO: 2310 - DNA, 107 bp, Artificial Sequence; identical to SEQ ID NO: 1960
  scaffold variant

SEQ ID NO: 2311 - DNA, 107 bp, Artificial Sequence; identical to SEQ ID NO: 1723
  scaffold variant

SEQ ID NO: 2312 - DNA, 107 bp, Artificial Sequence
  scaffold variant
actggcgcttttatctcattactttgagagccatcaccagcgactatgtcgtatgggtaaagcgcttatttagcggagagaaatccgataaataagaagcatcaaag

SEQ ID NO: 2313 - DNA, 107 bp, Artificial Sequence; identical to SEQ ID NO: 878
  scaffold variant

SEQ ID NO: 2314 - DNA, 107 bp, Artificial Sequence; identical to SEQ ID NO: 1017
  scaffold variant

SEQ ID NO: 2315 - DNA, 107 bp, Artificial Sequence; identical to SEQ ID NO: 1017
  scaffold variant

SEQ ID NO: 2316 - DNA, 108 bp, Artificial Sequence
  scaffold variant
gatggcgcttttatctcattactttgagagccatcaccagcgactatgtcgtatgggtaaagcgcttatttagtcggagagaaatccgataaataagaagcatcaaag

SEQ ID NO: 2317 - DNA, 107 bp, Artificial Sequence
  scaffold variant
actggcgcttttatctcattactttgagagccatcaccagcgactatgtcgtatgggtaaagcgcttatttgtcggagagaaatccgataaataagaagcatcaaag

SEQ ID NO: 2318 - DNA, 107 bp, Artificial Sequence; identical to SEQ ID NO: 1382
  scaffold variant

SEQ ID NO: 2319 - DNA, 107 bp, Artificial Sequence; identical to SEQ ID NO: 1960
  scaffold variant

SEQ ID NO: 2320 - DNA, 108 bp, Artificial Sequence
  scaffold variant
tactggcgcttttattctcattactttgagagccatcaccagcgactatgtcgtatgggtaaagctttatttatcggagagaaatccgataaataagaagcatcaaag

SEQ ID NO: 2321 - DNA, 108 bp, Artificial Sequence
  scaffold variant
tactggcgcttttatctcattactttgagagccatcaccagcgactatgtcgtatgggtaaagcgcttattttatcggagagaaatcgataaataagaagcatcaaag

SEQ ID NO: 2322 - DNA, 109 bp, Artificial Sequence; identical to SEQ ID NO: 1164
  scaffold variant

SEQ ID NO: 2323 - DNA, 107 bp, Artificial Sequence; identical to SEQ ID NO: 878
  scaffold variant

SEQ ID NO: 2324 - DNA, 109 bp, Artificial Sequence; identical to SEQ ID NO: 1600
  scaffold variant

SEQ ID NO: 2325 - DNA, 107 bp, Artificial Sequence
  scaffold variant
tacggcgcttttatctcattactttgagagccatcaccagcgactatgtcgtatgggtaaagcgcttatttataggagagaaatccgataaataagaagcatcaaag

SEQ ID NO: 2326 - DNA, 108 bp, Artificial Sequence
  scaffold variant
tactggcgcttttatctcattactttgagagccatcaccagcgactatgtcgtatgggtaaagcgcttatttatcgagagaaatccgataaataagagagcatcaaag

SEQ ID NO: 2327 - DNA, 107 bp, Artificial Sequence; identical to SEQ ID NO: 1307
  scaffold variant

SEQ ID NO: 2328 - DNA, 109 bp, Artificial Sequence; identical to SEQ ID NO: 1025
  scaffold variant

SEQ ID NO: 2329 - DNA, 107 bp, Artificial Sequence; identical to SEQ ID NO: 1382
  scaffold variant

SEQ ID NO: 2330 - DNA, 109 bp, Artificial Sequence; identical to SEQ ID NO: 1164
  scaffold variant

SEQ ID NO: 2331 - DNA, 107 bp, Artificial Sequence; identical to SEQ ID NO: 878
  scaffold variant

SEQ ID NO: 2332 - DNA, 107 bp, Artificial Sequence
  scaffold variant
cactggcgcttttatctcattactttgagagccatcaccagcgactatgtcgtatgggtaaagcgcttatttatcgagagaaatccgataaataagaagcatcaaag

SEQ ID NO: 2333 - DNA, 109 bp, Artificial Sequence; identical to SEQ ID NO: 1055
  scaffold variant

SEQ ID NO: 2334 - DNA, 107 bp, Artificial Sequence; identical to SEQ ID NO: 878
  scaffold variant

SEQ ID NO: 2335 - DNA, 107 bp, Artificial Sequence; identical to SEQ ID NO: 878
  scaffold variant

SEQ ID NO: 2336 - DNA, 108 bp, Artificial Sequence
  scaffold variant
tcactggcgcttttatctcattactttgagagccatcaccagcgactatgtcgtatgggtaaagcgcttatttatcaagagaaatccgataaataagaagcatcaaag

SEQ ID NO: 2337 - DNA, 106 bp, Artificial Sequence; identical to SEQ ID NO: 1829
  scaffold variant

SEQ ID NO: 2338 - DNA, 107 bp, Artificial Sequence; identical to SEQ ID NO: 1723
  scaffold variant

SEQ ID NO: 2339 - DNA, 109 bp, Artificial Sequence; identical to SEQ ID NO: 1055
  scaffold variant

SEQ ID NO: 2340 - DNA, 109 bp, Artificial Sequence; identical to SEQ ID NO: 882
  scaffold variant

SEQ ID NO: 2341 - DNA, 108 bp, Artificial Sequence; identical to SEQ ID NO: 434
  scaffold variant

SEQ ID NO: 2342 - DNA, 107 bp, Artificial Sequence; identical to SEQ ID NO: 878
  scaffold variant

SEQ ID NO: 2343 - DNA, 107 bp, Artificial Sequence
  scaffold variant
tactggcgcttttatctcattactttgagagccatcaccagcgactatgtcgtatgggtaaagcgcttatttatcggagagaaagagataaataagaagcatcaaag

SEQ ID NO: 2344 - DNA, 109 bp, Artificial Sequence
  scaffold variant
tactggcgcttttatcttcattactttgagagccatcaccagcgactatgtcgtatgggtaaagcgcttatttatcggggagaaatccgataaataagaagcatcaaag

SEQ ID NO: 2345 - DNA, 108 bp, Artificial Sequence; identical to SEQ ID NO: 937
  scaffold variant

SEQ ID NO: 2346 - DNA, 107 bp, Artificial Sequence; identical to SEQ ID NO: 1752
  scaffold variant

SEQ ID NO: 2347 - DNA, 108 bp, Artificial Sequence
  scaffold variant
tactggcgcttttatctcattactttgagagccatcaccagcgactatgtcgtattgggtaaagcgcttatttatcggaagaaatccgataaataagaagcatcaaag

SEQ ID NO: 2348 - DNA, 110 bp, Artificial Sequence
  scaffold variant
tactggcgcttttatctctattactttgagagccatcaccagcgactatgtcgtattgggtaaagcgcttatttatcggagagaaatccgataaataagaagcatcaaag

SEQ ID NO: 2349 - DNA, 107 bp, Artificial Sequence; identical to SEQ ID NO: 1802
  scaffold variant

SEQ ID NO: 2350 - DNA, 106 bp, Artificial Sequence; identical to SEQ ID NO: 430
  scaffold variant

SEQ ID NO: 2351 - DNA, 108 bp, Artificial Sequence
  scaffold variant
tactggcgcttttatctcgattactttgagagccatcaccagcgactatgtcgtatgggtaaagcgcttatttatcggagagaaatcgataaataagaagcatcaaag

SEQ ID NO: 2352 - DNA, 107 bp, Artificial Sequence; identical to SEQ ID NO: 1081
  scaffold variant

SEQ ID NO: 2353 - DNA, 108 bp, Artificial Sequence
  scaffold variant
gctggcgcttttatctcattactttgagagccatcaccagcgactatgtcgtatgggtaaagcgcttatttatcggagagacaatccgataaataagaagcatcaaag

SEQ ID NO: 2354 - DNA, 108 bp, Artificial Sequence
  scaffold variant
atactggcgcttttatctcattactttgagagccatcaccagcgactatgtcgtatgggtaaagcgcttatttatctagagaaatccgataaataagaagcatcaaag

SEQ ID NO: 2355 - DNA, 109 bp, Artificial Sequence; identical to SEQ ID NO: 1055
  scaffold variant

SEQ ID NO: 2356 - DNA, 107 bp, Artificial Sequence; identical to SEQ ID NO: 1307
  scaffold variant

SEQ ID NO: 2357 - DNA, 109 bp, Artificial Sequence; identical to SEQ ID NO: 785
  scaffold variant

SEQ ID NO: 2358 - DNA, 108 bp, Artificial Sequence
  scaffold variant
tactggcgcttttatctcattactttgagagccatcaccagcgactatgtcgtatgggtaaagcgcttatttatcgggagaaatccgataaataagtaagcatcaaag

SEQ ID NO: 2359 - DNA, 106 bp, Artificial Sequence; identical to SEQ ID NO: 504
  scaffold variant

SEQ ID NO: 2360 - DNA, 108 bp, Artificial Sequence
  scaffold variant
tactggcgcttttatctcattactttgagagccatcaccagcgactatgtcgtatgggtaaagcggtatttatcggagagaaatccgaataaataagaagcatcaaag

SEQ ID NO: 2361 - DNA, 110 bp, Artificial Sequence
  scaffold variant
tactggcgcttttatctcattactttgagagccatcaccagcgactatgtcgtatgggtaaagcgcttattgtatcggagagaaatcccgataaataagaagcatcaaag

SEQ ID NO: 2362 - DNA, 110 bp, Artificial Sequence
  scaffold variant
tactggcgcttttatctcattactttgagagccatcaccagcgactatgtcgtatgggtaaagcgcttatttatctggagagaaatcgcgataaataagaagcatcaaag

SEQ ID NO: 2363 - DNA, 107 bp, Artificial Sequence; identical to SEQ ID NO: 878
  scaffold variant

SEQ ID NO: 2364 - DNA, 107 bp, Artificial Sequence; identical to SEQ ID NO: 1960
  scaffold variant

SEQ ID NO: 2365 - DNA, 108 bp, Artificial Sequence
  scaffold variant
tactggcgcttttatctcattactttgagagccatcaccagcgactatgtcgtatgggtaaagcgcttatttatacggagagaaatccataaataagaagcatcaaag

SEQ ID NO: 2366 - DNA, 107 bp, Artificial Sequence; identical to SEQ ID NO: 1471
  scaffold variant

SEQ ID NO: 2367 - DNA, 110 bp, Artificial Sequence
  scaffold variant
tactggcgcttttatactcattactttgagagccatcaccagcgactatgtcgtatgggtaaagcgcttatttagtcggagagaaatccgataaataagaagcatcaaag

SEQ ID NO: 2368 - DNA, 106 bp, Artificial Sequence
  scaffold variant
tactggcgcttttatctcattactttgagagccatcaccagcgactatgtcgtatgggtaaagcgcttatttatcgagagaaatccataaataagaagcatcaaag

SEQ ID NO: 2369 - DNA, 107 bp, Artificial Sequence; identical to SEQ ID NO: 528
  scaffold variant

SEQ ID NO: 2370 - DNA, 107 bp, Artificial Sequence; identical to SEQ ID NO: 1960
  scaffold variant

SEQ ID NO: 2371 - DNA, 107 bp, Artificial Sequence; identical to SEQ ID NO: 1017
  scaffold variant

SEQ ID NO: 2372 - DNA, 107 bp, Artificial Sequence; identical to SEQ ID NO: 878
  scaffold variant

SEQ ID NO: 2373 - DNA, 107 bp, Artificial Sequence; identical to SEQ ID NO: 1307
  scaffold variant

SEQ ID NO: 2374 - DNA, 110 bp, Artificial Sequence
  scaffold variant
atactggcgcttttatctcattactttgagagccatcaccagcgactatgtcgtatgggtaaagcgcttatttaatcggagagaaatccgataaataagaagcatcaaag

SEQ ID NO: 2375 - DNA, 107 bp, Artificial Sequence; identical to SEQ ID NO: 1017
  scaffold variant

SEQ ID NO: 2376 - DNA, 110 bp, Artificial Sequence
  scaffold variant
tactggcgcttttatctgcattactttgagagccatcaccagcgactatgtcgtatgggtaaagcgcttatttatcggagagaaatccgataaataagagagcatcaaag

SEQ ID NO: 2377 - DNA, 107 bp, Artificial Sequence; identical to SEQ ID NO: 1081
  scaffold variant

SEQ ID NO: 2378 - DNA, 106 bp, Artificial Sequence; identical to SEQ ID NO: 430
  scaffold variant

SEQ ID NO: 2379 - DNA, 107 bp, Artificial Sequence; identical to SEQ ID NO: 1263
  scaffold variant

SEQ ID NO: 2380 - DNA, 109 bp, Artificial Sequence; identical to SEQ ID NO: 1093
  scaffold variant

SEQ ID NO: 2381 - DNA, 107 bp, Artificial Sequence; identical to SEQ ID NO: 1752
  scaffold variant

SEQ ID NO: 2382 - DNA, 110 bp, Artificial Sequence
  scaffold variant
tactggcgcttttatctcgattactttgagagccatcaccagcgactatgtcgtatgggtaaagcgcttatttatcgtgagagaaatccgataaataagaagcatcaaag

SEQ ID NO: 2383 - DNA, 107 bp, Artificial Sequence; identical to SEQ ID NO: 1081
  scaffold variant

SEQ ID NO: 2384 - DNA, 106 bp, Artificial Sequence; identical to SEQ ID NO: 1829
  scaffold variant

SEQ ID NO: 2385 - DNA, 107 bp, Artificial Sequence; identical to SEQ ID NO: 1960
  scaffold variant

SEQ ID NO: 2386 - DNA, 109 bp, Artificial Sequence; identical to SEQ ID NO: 957
  scaffold variant

SEQ ID NO: 2387 - DNA, 107 bp, Artificial Sequence; identical to SEQ ID NO: 1142
  scaffold variant

SEQ ID NO: 2388 - DNA, 107 bp, Artificial Sequence; identical to SEQ ID NO: 1307
  scaffold variant

SEQ ID NO: 2389 - DNA, 107 bp, Artificial Sequence; identical to SEQ ID NO: 810
  scaffold variant

SEQ ID NO: 2390 - DNA, 107 bp, Artificial Sequence; identical to SEQ ID NO: 878
  scaffold variant

SEQ ID NO: 2391 - DNA, 108 bp, Artificial Sequence
  scaffold variant
tactggcgcttttatctcattactttgagagccatcaccagcgactatgtcgtatgggtaaagcgcttatttatcgagagaaatccgataaataagaagcatcaaagc

SEQ ID NO: 2392 - DNA, 106 bp, Artificial Sequence; identical to SEQ ID NO: 529
  scaffold variant

SEQ ID NO: 2393 - DNA, 109 bp, Artificial Sequence; identical to SEQ ID NO: 1210
  scaffold variant

SEQ ID NO: 2394 - DNA, 107 bp, Artificial Sequence; identical to SEQ ID NO: 960
  scaffold variant

SEQ ID NO: 2395 - DNA, 106 bp, Artificial Sequence
  scaffold variant
tactggcgcttttatctcattactttgagagccatcaccagcgactatgtcgtatgggtaaagcgcttatttatcggagagatccgataaataagaagcatcaaag

SEQ ID NO: 2396 - DNA, 107 bp, Artificial Sequence; identical to SEQ ID NO: 1382
  scaffold variant

SEQ ID NO: 2397 - DNA, 109 bp, Artificial Sequence; identical to SEQ ID NO: 882
  scaffold variant

SEQ ID NO: 2398 - DNA, 107 bp, Artificial Sequence; identical to SEQ ID NO: 1136
  scaffold variant

SEQ ID NO: 2399 - DNA, 109 bp, Artificial Sequence; identical to SEQ ID NO: 785
  scaffold variant

SEQ ID NO: 2400 - DNA, 107 bp, Artificial Sequence; identical to SEQ ID NO: 878
  scaffold variant

SEQ ID NO: 2401 - DNA, 109 bp, Artificial Sequence; identical to SEQ ID NO: 563
  scaffold variant

SEQ ID NO: 2402 - DNA, 109 bp, Artificial Sequence
  scaffold variant
tactggcgcttttatcctcattactttgagagccatcaccagcgactatgtcgtatgggtaaagcgcttatttatcggggagaaatccgataaataagaagcatcaaag

SEQ ID NO: 2403 - DNA, 107 bp, Artificial Sequence; identical to SEQ ID NO: 1960
  scaffold variant

SEQ ID NO: 2404 - DNA, 108 bp, Artificial Sequence
  scaffold variant
tactggcgcttttatctcattactttgagagccatcaccagcgactatgtcgtatgggtaaagcggtatttatcggagagaaatcctgataaataagaagcatcaaag

SEQ ID NO: 2405 - DNA, 107 bp, Artificial Sequence; identical to SEQ ID NO: 1142
  scaffold variant

SEQ ID NO: 2406 - DNA, 106 bp, Artificial Sequence; identical to SEQ ID NO: 663
  scaffold variant

SEQ ID NO: 2407 - DNA, 107 bp, Artificial Sequence; identical to SEQ ID NO: 1382
  scaffold variant

SEQ ID NO: 2408 - DNA, 107 bp, Artificial Sequence; identical to SEQ ID NO: 1136
  scaffold variant

SEQ ID NO: 2409 - DNA, 107 bp, Artificial Sequence; identical to SEQ ID NO: 1307
  scaffold variant

SEQ ID NO: 2410 - DNA, 105 bp, Artificial Sequence
  scaffold variant
ctggcgcttttatctcattactttgagagccatcaccagcgactatgtcgtatgggtaaagcgcttatttatcggagagcatccgataaataagaagcatcaaag

SEQ ID NO: 2411 - DNA, 109 bp, Artificial Sequence; identical to SEQ ID NO: 1049
  scaffold variant

SEQ ID NO: 2412 - DNA, 106 bp, Artificial Sequence; identical to SEQ ID NO: 446
  scaffold variant

SEQ ID NO: 2413 - DNA, 109 bp, Artificial Sequence; identical to SEQ ID NO: 785
  scaffold variant

SEQ ID NO: 2414 - DNA, 105 bp, Artificial Sequence
  scaffold variant
tactggcgcttttatctcattactttgagagccatcaccagcgactatgtcgtatgggtaaagcggtatttatcggagaaatccgataaataagaagcatcaaag

SEQ ID NO: 2415 - DNA, 108 bp, Artificial Sequence
  scaffold variant
tactggcgcttttattctcattactttgagagccatcaccagcgactatgtcgtatgggtaaagcgcttatttatcggagagaaaacgataaataagaagcatcaaag

SEQ ID NO: 2416 - DNA, 108 bp, Artificial Sequence
  scaffold variant
tactggcgcttttatctgcattactttgagagccatcaccagcgactatgtcgtatgggtaaagcgcttatttatcgggagaaatccgataaataagaagcatcaaag

SEQ ID NO: 2417 - DNA, 109 bp, Artificial Sequence; identical to SEQ ID NO: 1831
  scaffold variant

SEQ ID NO: 2418 - DNA, 109 bp, Artificial Sequence; identical to SEQ ID NO: 1025
  scaffold variant

SEQ ID NO: 2419 - DNA, 109 bp, Artificial Sequence; identical to SEQ ID NO: 1228
  scaffold variant

SEQ ID NO: 2420 - DNA, 106 bp, Artificial Sequence
  scaffold variant
tactggcgcttttattcattactttgagagccatcaccagcgactatgtcgtatgggtaaagcgcttatttatccagagaaatccgataaataagaagcatcaaag

SEQ ID NO: 2421 - DNA, 108 bp, Artificial Sequence
  scaffold variant
tacggcgcttttatctcattactttgagagccatcaccagcgactatgtcgtatgggtaaagcgcttattgtatcggagagaaatccgataaataagaagcatcaaag

SEQ ID NO: 2422 - DNA, 107 bp, Artificial Sequence; identical to SEQ ID NO: 1307
  scaffold variant

SEQ ID NO: 2423 - DNA, 108 bp, Artificial Sequence
  scaffold variant
tactggcgcttttatctcattactttgagagccatcaccagcgactatgtcgtatgggtaaagcgcttatttacggagagaaatctcgataaataagaagcatcaaag

SEQ ID NO: 2424 - DNA, 110 bp, Artificial Sequence
  scaffold variant
tactggcgcttttatactcattactttgagagccatcaccagcgactatgtcgtatgggtaaagcgcttatttatacggagagaaatccgataaataagaagcatcaaag

SEQ ID NO: 2425 - DNA, 107 bp, Artificial Sequence
  scaffold variant
tactggcgcctttatctcattactttgagagccatcaccagcgactatgtcgtatgggtaaagcgcttatttattgagagaaatccgataaataagaagcatcaaag

SEQ ID NO: 2426 - DNA, 106 bp, Artificial Sequence; identical to SEQ ID NO: 1829
  scaffold variant

SEQ ID NO: 2427 - DNA, 108 bp, Artificial Sequence
  scaffold variant
tactggcgcttttatctcattactttgagagccatcaccagcgactatgtcgtagtgggtaaagcgcttatttatccagagaaatccgataaataagaagcatcaaag

SEQ ID NO: 2428 - DNA, 107 bp, Artificial Sequence
  scaffold variant
tactggcgcttttatctcattactttgagagccataaccagcgactatgtcgtatgggtaaagcgcttatttatccagagaaatccgataaataagaagcatcaaag

SEQ ID NO: 2429 - DNA, 109 bp, Artificial Sequence; identical to SEQ ID NO: 1093
  scaffold variant

SEQ ID NO: 2430 - DNA, 110 bp, Artificial Sequence
  scaffold variant
tactggcgcttttatctcattactttgagagccatcaccagcgactatgtcgtatgggtaaagcgcttatttatacggagagaaatcacgataaataagaagcatcaaag

SEQ ID NO: 2431 - DNA, 108 bp, Artificial Sequence
  scaffold variant
gctggcgcttttaatctcattactttgagagccatcaccagcgactatgtcgtatgggtaaagcgcttatttatcggagagaaatccgataaataagaagcatcaaag

SEQ ID NO: 2432 - DNA, 107 bp, Artificial Sequence
  scaffold variant
tactggcgcttttatctcattactttgagagccatcaccagcgactatgtcgtatgggtaaagcgcttatttatcggagagaaatccctaaataagaagcatcaaag

SEQ ID NO: 2433 - DNA, 107 bp, Artificial Sequence
  scaffold variant
atggcgcttttatctcattactttgagagccatcaccagcgactatgtcgtatgggtaaagcgcttatttaatcggagagaaatccgataaataagaagcatcaaag

SEQ ID NO: 2434 - DNA, 107 bp, Artificial Sequence; identical to SEQ ID NO: 878
  scaffold variant

SEQ ID NO: 2435 - DNA, 112 bp, Artificial Sequence
  scaffold variant
taactggcgcttttatctcattactttgagagccatcaccagcgactatgtcgtagtgggtaaagcgcttatttatcggagagaaatccgataaataagtaaagcatcaaag

SEQ ID NO: 2436 - DNA, 109 bp, Artificial Sequence
  scaffold variant
tactggcgcttttatctcattactttgagagccatcaccagcgactatgtcgtatgggtaaagcgcttatttatcggtagagaaatccgataaataagaagcatcaaag

SEQ ID NO: 2437 - DNA, 106 bp, Artificial Sequence
  scaffold variant
tactggcgcttttatctcattactttgagagccatcaccagcgactatgtcgtatgggtaaagcgcttatttatcgagagaaatccgatagtaagaagcatcaaag

SEQ ID NO: 2438 - DNA, 107 bp, Artificial Sequence; identical to SEQ ID NO: 1471
  scaffold variant

SEQ ID NO: 2439 - DNA, 110 bp, Artificial Sequence
  scaffold variant
tactggcgcttttatctcattactttgagagccatcaccagcgactatgtcgtatgggtaaagcgcttatttatcaggagagaaatcccgataaataagaagcatcaaag

SEQ ID NO: 2440 - DNA, 110 bp, Artificial Sequence
  scaffold variant
tactggcgcttttatctcattactttgagagccatcaccagcgactatgtcgtatgggtaaagcgcttattttatcggagagaaatctcgataaataagaagcatcaaag

SEQ ID NO: 2441 - DNA, 107 bp, Artificial Sequence; identical to SEQ ID NO: 1972
  scaffold variant

SEQ ID NO: 2442 - DNA, 110 bp, Artificial Sequence
  scaffold variant
tactggcgcttttatctcattactttgagagccatcaccagcgactatgtcgtatgggtaaagcgcttatttaatcggagagaaatcgcgataaataagaagcatcaaag

SEQ ID NO: 2443 - DNA, 107 bp, Artificial Sequence
  scaffold variant
tactggcgcttttatctcattactttgagagccatcaccagcgactatgtcgtatgggtaaagcgcttatttgcggagagaaatccgataaataagaagcatcaaag

SEQ ID NO: 2444 - DNA, 109 bp, Artificial Sequence; identical to SEQ ID NO: 1025
  scaffold variant

SEQ ID NO: 2445 - DNA, 108 bp, Artificial Sequence
  scaffold variant
tactggcgcttttatctctattactttgagagccatcaccagcgactatgtcgtatgggtaaagcgcttatttatcggagagtatccgataaataagaagcatcaaag

SEQ ID NO: 2446 - DNA, 107 bp, Artificial Sequence
  scaffold variant
tactggcgcttttatttcattactttgagagccatcaccagcgactatgtcgtatgggtaaagcgcttatttatcgggagaaatccgataaataagaagcatcaaag

SEQ ID NO: 2447 - DNA, 109 bp, Artificial Sequence; identical to SEQ ID NO: 1093
  scaffold variant

SEQ ID NO: 2448 - DNA, 107 bp, Artificial Sequence
  scaffold variant
cctggcgcttttatctcattactttgagagccatcaccagcgactatgtcgtatgggtaaagcgcttatttatcggaaagaaatccgataaataagaagcatcaaag

SEQ ID NO: 2449 - DNA, 106 bp, Artificial Sequence
  scaffold variant
actggcgcttttatctattactttgagagccatcaccagcgactatgtcgtatgggtaaagcgcttatttatcggagagaaatccgataaataagaagcatcaaag

SEQ ID NO: 2450 - DNA, 106 bp, Artificial Sequence
  scaffold variant
tactggcgcttttatctcattactttgagagccatcaccagcgactatgtcgtatgggtaaagcgcttattttcggagagaaatcgataaataagaagcatcaaag

SEQ ID NO: 2451 - DNA, 107 bp, Artificial Sequence; identical to SEQ ID NO: 1017
  scaffold variant

SEQ ID NO: 2452 - DNA, 108 bp, Artificial Sequence
  scaffold variant
tactggcgcttttatctcattactttgagagccatcaccagcgactatgtcgtatgggtaaagcgcttatttatggagagaaatcccgataaataagaagcatcaaag

SEQ ID NO: 2453 - DNA, 109 bp, Artificial Sequence; identical to SEQ ID NO: 1228
  scaffold variant

SEQ ID NO: 2454 - DNA, 107 bp, Artificial Sequence; identical to SEQ ID NO: 1382
  scaffold variant

SEQ ID NO: 2455 - DNA, 109 bp, Artificial Sequence
  scaffold variant
tcctggcgcttttatctcattactttgagagccatcaccagcgactatgtcgtatgggtaaagcgcttatttatgcggagagaaatccgataaataagaagcatcaaag

SEQ ID NO: 2456 - DNA, 109 bp, Artificial Sequence; identical to SEQ ID NO: 785
  scaffold variant

SEQ ID NO: 2457 - DNA, 109 bp, Artificial Sequence; identical to SEQ ID NO: 1600
  scaffold variant

SEQ ID NO: 2458 - DNA, 107 bp, Artificial Sequence
  scaffold variant
tactggcgcttttatctcattactttgagagccatcaccagcgactatgtcgtatgggtaaagcgcttatttatcggagagtatccgataaataagaagcatcaaag

SEQ ID NO: 2459 - DNA, 106 bp, Artificial Sequence; identical to SEQ ID NO: 1979
  scaffold variant

SEQ ID NO: 2460 - DNA, 110 bp, Artificial Sequence
  scaffold variant
tactggcgcttttatctcattactttgagagccatcaccagcgactatgtcgtatgggtaaagcgcttattctatcggagagaaatcccgataaataagaagcatcaaag

SEQ ID NO: 2461 - DNA, 105 bp, Artificial Sequence
  scaffold variant
atggcgcttttatctcattactttgagagccatcaccagcgactatgtcgtatgggtaaagcgcttatttatcggagagcatccgataaataagaagcatcaaag

SEQ ID NO: 2462 - DNA, 110 bp, Artificial Sequence
  scaffold variant
tactggcgcttttatctcattactttgagagccatcaccagcgactatgtcgtatgggtaaagcgcttatttatcgggagagaaatccgataaataagagagcatcaaag

SEQ ID NO: 2463 - DNA, 107 bp, Artificial Sequence; identical to SEQ ID NO: 1752
  scaffold variant

SEQ ID NO: 2464 - DNA, 105 bp, Artificial Sequence
  scaffold variant
actggcgcttttatctcattactttgagagccatcaccagcgactatgtcgtatgggtaaagcgtatttatcggagagaaatccgataaataagaagcatcaaag

SEQ ID NO: 2465 - DNA, 110 bp, Artificial Sequence
  scaffold variant
tactggcgcttttatactcattactttgagagccatcaccagcgactatgtcgtatgggtaaagcgcttatttatcggagagaaatcccgataaataagaagcatcaaag

SEQ ID NO: 2466 - DNA, 109 bp, Artificial Sequence; identical to SEQ ID NO: 1025
  scaffold variant

SEQ ID NO: 2467 - DNA, 107 bp, Artificial Sequence; identical to SEQ ID NO: 1471
  scaffold variant

SEQ ID NO: 2468 - DNA, 109 bp, Artificial Sequence; identical to SEQ ID NO: 1093
  scaffold variant

SEQ ID NO: 2469 - DNA, 107 bp, Artificial Sequence; identical to SEQ ID NO: 1017
  scaffold variant

SEQ ID NO: 2470 - DNA, 107 bp, Artificial Sequence; identical to SEQ ID NO: 1081
  scaffold variant

SEQ ID NO: 2471 - DNA, 109 bp, Artificial Sequence; identical to SEQ ID NO: 1831
  scaffold variant

SEQ ID NO: 2472 - DNA, 105 bp, Artificial Sequence
  scaffold variant
ctggcgcttttatctcattactttgagagccatcaccagcgactatgtcgtatgggtaaagcgcttatttatcggagaggatccgataaataagaagcatcaaag

SEQ ID NO: 2473 - DNA, 109 bp, Artificial Sequence; identical to SEQ ID NO: 1222
  scaffold variant

SEQ ID NO: 2474 - DNA, 107 bp, Artificial Sequence; identical to SEQ ID NO: 2458
  scaffold variant

SEQ ID NO: 2475 - DNA, 107 bp, Artificial Sequence; identical to SEQ ID NO: 878
  scaffold variant

SEQ ID NO: 2476 - DNA, 109 bp, Artificial Sequence; identical to SEQ ID NO: 785
  scaffold variant

SEQ ID NO: 2477 - DNA, 108 bp, Artificial Sequence
  scaffold variant
tactggcgcttttatctcattactttgagagccatcaccagcgactatgtcgtatgggtaaagcgcttatttatgcggagagaaatccgataataagaagcatcaaag

SEQ ID NO: 2478 - DNA, 109 bp, Artificial Sequence; identical to SEQ ID NO: 1228
  scaffold variant

SEQ ID NO: 2479 - DNA, 107 bp, Artificial Sequence; identical to SEQ ID NO: 1960
  scaffold variant

SEQ ID NO: 2480 - DNA, 107 bp, Artificial Sequence; identical to SEQ ID NO: 1307
  scaffold variant

SEQ ID NO: 2481 - DNA, 109 bp, Artificial Sequence; identical to SEQ ID NO: 1600
  scaffold variant

SEQ ID NO: 2482 - DNA, 107 bp, Artificial Sequence; identical to SEQ ID NO: 878
  scaffold variant

SEQ ID NO: 2483 - DNA, 109 bp, Artificial Sequence; identical to SEQ ID NO: 785
  scaffold variant

SEQ ID NO: 2484 - DNA, 106 bp, Artificial Sequence; identical to SEQ ID NO: 448
  scaffold variant

SEQ ID NO: 2485 - DNA, 107 bp, Artificial Sequence; identical to SEQ ID NO: 1382
  scaffold variant

SEQ ID NO: 2486 - DNA, 107 bp, Artificial Sequence; identical to SEQ ID NO: 1382
  scaffold variant

SEQ ID NO: 2487 - DNA, 109 bp, Artificial Sequence; identical to SEQ ID NO: 1093
  scaffold variant

SEQ ID NO: 2488 - DNA, 109 bp, Artificial Sequence; identical to SEQ ID NO: 1228
  scaffold variant

SEQ ID NO: 2489 - DNA, 106 bp, Artificial Sequence
  scaffold variant
tggcgcttttatctcattactttgagagccatcaccagcgactatgtcgtatgggtaaagcgcttatttatcggagagaaatcacgataaataagaagcatcaaag

SEQ ID NO: 2490 - DNA, 107 bp, Artificial Sequence; identical to SEQ ID NO: 1263
  scaffold variant

SEQ ID NO: 2491 - DNA, 109 bp, Artificial Sequence; identical to SEQ ID NO: 955
  scaffold variant

SEQ ID NO: 2492 - DNA, 110 bp, Artificial Sequence
  scaffold variant
atactggcgcttttatctcattactttgagagccatcaccagcgactatgtcgtatgggtaaagcgcttatttatcgagagagaaatccgataaataagaagcatcaaag

SEQ ID NO: 2493 - DNA, 108 bp, Artificial Sequence
  scaffold variant
tactggcgcttttatctcattactttgagagccatcaccagcgactatgtcgtatgggtaaagcgcttatttagtcggagagaaatcgataaataagaagcatcaaag

SEQ ID NO: 2494 - DNA, 109 bp, Artificial Sequence
  scaffold variant
tactggcgcttttatctcattactttgagagccatcaccagcgactatgtcgtatgggtaaagcgcttatttatagggagagaaatccgataaataagaagcatcaaag

SEQ ID NO: 2495 - DNA, 110 bp, Artificial Sequence
  scaffold variant
tactggcgcttttatctcattactttgagagccatcaccagcgactatgtcgtatgggtaaagcgcttatttagtcggagagaaatctcgataaataagaagcatcaaag

SEQ ID NO: 2496 - DNA, 107 bp, Artificial Sequence; identical to SEQ ID NO: 2458
  scaffold variant

SEQ ID NO: 2497 - DNA, 108 bp, Artificial Sequence; identical to SEQ ID NO: 427
  scaffold variant

SEQ ID NO: 2498 - DNA, 107 bp, Artificial Sequence
  scaffold variant
cctgtcgcttttatctcattactttgagagccatcaccagcgactatgtcgtatgggtaaagcgcttatttatcggagagaaatccgataaataagaagcatcaaag

SEQ ID NO: 2499 - DNA, 107 bp, Artificial Sequence
  scaffold variant
tactggcgcttttatctcattactttgagagccatcaccagcgactatgtcgtatgggtaaagcgcttatttatcggagatcatccgataaataagaagcatcaaag

SEQ ID NO: 2500 - DNA, 107 bp, Artificial Sequence; identical to SEQ ID NO: 1382
  scaffold variant

SEQ ID NO: 2501 - DNA, 107 bp, Artificial Sequence; identical to SEQ ID NO: 1736
  scaffold variant

SEQ ID NO: 2502 - DNA, 109 bp, Artificial Sequence; identical to SEQ ID NO: 1600
  scaffold variant

SEQ ID NO: 2503 - DNA, 106 bp, Artificial Sequence; identical to SEQ ID NO: 1979
  scaffold variant

SEQ ID NO: 2504 - DNA, 108 bp, Artificial Sequence
  scaffold variant
tactggcgcttttatctattactttgagagccatcaccagcgactatgtcgtatgggtaaagcgcttatttatcgagagagaaatccgataaataagaagcatcaaag

SEQ ID NO: 2505 - DNA, 109 bp, Artificial Sequence
  scaffold variant
tctggcgcttttattctcattactttgagagccatcaccagcgactatgtcgtatgggtaaagcgcttatttatgcggagagaaatccgataaataagaagcatcaaag

SEQ ID NO: 2506 - DNA, 109 bp, Artificial Sequence; identical to SEQ ID NO: 785
  scaffold variant

SEQ ID NO: 2507 - DNA, 107 bp, Artificial Sequence; identical to SEQ ID NO: 1723
  scaffold variant

SEQ ID NO: 2508 - DNA, 109 bp, Artificial Sequence; identical to SEQ ID NO: 847
  scaffold variant

SEQ ID NO: 2509 - DNA, 107 bp, Artificial Sequence; identical to SEQ ID NO: 1263
  scaffold variant

SEQ ID NO: 2510 - DNA, 110 bp, Artificial Sequence
  scaffold variant
tactggcgcttttatctcattactttgagagccatcaccagcgactatgtcgtatgggtaaagcgcttatttattcggagagaaatcacgataaataagaagcatcaaag

SEQ ID NO: 2511 - DNA, 109 bp, Artificial Sequence; identical to SEQ ID NO: 785
  scaffold variant

SEQ ID NO: 2512 - DNA, 109 bp, Artificial Sequence; identical to SEQ ID NO: 785
  scaffold variant

SEQ ID NO: 2513 - DNA, 109 bp, Artificial Sequence; identical to SEQ ID NO: 1025
  scaffold variant

SEQ ID NO: 2514 - DNA, 107 bp, Artificial Sequence; identical to SEQ ID NO: 1960
  scaffold variant

SEQ ID NO: 2515 - DNA, 108 bp, Artificial Sequence; identical to SEQ ID NO: 422
  scaffold variant

SEQ ID NO: 2516 - DNA, 107 bp, Artificial Sequence; identical to SEQ ID NO: 1017
  scaffold variant

SEQ ID NO: 2517 - DNA, 110 bp, Artificial Sequence
  scaffold variant
ttactggcgcttttatctcattactttgagagccatcaccagcgactatgtcgtatgggtaaagcgcttatttatcggagagaaatcccgataaataagaagcatcaaag

SEQ ID NO: 2518 - DNA, 107 bp, Artificial Sequence; identical to SEQ ID NO: 1752
  scaffold variant

SEQ ID NO: 2519 - DNA, 109 bp, Artificial Sequence; identical to SEQ ID NO: 1055
  scaffold variant

SEQ ID NO: 2520 - DNA, 107 bp, Artificial Sequence; identical to SEQ ID NO: 1509
  scaffold variant

SEQ ID NO: 2521 - DNA, 109 bp, Artificial Sequence; identical to SEQ ID NO: 986
  scaffold variant

SEQ ID NO: 2522 - DNA, 108 bp, Artificial Sequence
  scaffold variant
tactggcgcttttatcctcattactttgagagccatcaccagcgactatgtcgtatgggtaaagcgcttatttatcggagagaaatagataaataagaagcatcaaag

SEQ ID NO: 2523 - DNA, 108 bp, Artificial Sequence; identical to SEQ ID NO: 1279
  scaffold variant

SEQ ID NO: 2524 - DNA, 109 bp, Artificial Sequence; identical to SEQ ID NO: 957
  scaffold variant

SEQ ID NO: 2525 - DNA, 106 bp, Artificial Sequence; identical to SEQ ID NO: 1979
  scaffold variant

SEQ ID NO: 2526 - DNA, 109 bp, Artificial Sequence; identical to SEQ ID NO: 847
  scaffold variant

SEQ ID NO: 2527 - DNA, 108 bp, Artificial Sequence
  scaffold variant
tactggcgcttttatctcattactttgagagccatcaccagcgactatgtcgtatgggtaaagcgcttatttatcgagagaaatctcgataaataagaagcatcaaag

SEQ ID NO: 2528 - DNA, 110 bp, Artificial Sequence
  scaffold variant
tactggcgcttttatctcattactttgagagccatcaccagcgactatgtcgtatgggtaaagcgcttatttaatcggagagaaatcccgataaataagaagcatcaaag

SEQ ID NO: 2529 - DNA, 107 bp, Artificial Sequence; identical to SEQ ID NO: 1142
  scaffold variant

SEQ ID NO: 2530 - DNA, 107 bp, Artificial Sequence
  scaffold variant
tactggcgcttttatctcattactttgagagccatcaccagcgactatgtcgtatgggtaaagcgcttatttatctcgagaaatccgataaataagaagcatcaaag

SEQ ID NO: 2531 - DNA, 107 bp, Artificial Sequence
  scaffold variant
ctggcgcttttatctgcattactttgagagccatcaccagcgactatgtcgtatgggtaaagcgcttatttatcggagagaaatccgataaataagaagcatcaaag

SEQ ID NO: 2532 - DNA, 107 bp, Artificial Sequence; identical to SEQ ID NO: 960
  scaffold variant

SEQ ID NO: 2533 - DNA, 110 bp, Artificial Sequence
  scaffold variant
tactggcgcttttatcctcattactttgagagccatcaccagcgactatgtcgtatgggtaaagcgcttatttatcggagagaaatccgtataaataagaagcatcaaag

SEQ ID NO: 2534 - DNA, 107 bp, Artificial Sequence
  scaffold variant
tactggcgcttttatctcattactttgagagccatcaccagcgactatgtcgtatgggtaaagcgcttatttatcggagagaaaaagataaataagaagcatcaaag

SEQ ID NO: 2535 - DNA, 107 bp, Artificial Sequence; identical to SEQ ID NO: 1263
  scaffold variant

SEQ ID NO: 2536 - DNA, 106 bp, Artificial Sequence; identical to SEQ ID NO: 807
  scaffold variant

SEQ ID NO: 2537 - DNA, 107 bp, Artificial Sequence; identical to SEQ ID NO: 1081
  scaffold variant

SEQ ID NO: 2538 - DNA, 108 bp, Artificial Sequence; identical to SEQ ID NO: 422
  scaffold variant

SEQ ID NO: 2539 - DNA, 109 bp, Artificial Sequence; identical to SEQ ID NO: 1831
  scaffold variant

SEQ ID NO: 2540 - DNA, 107 bp, Artificial Sequence
  scaffold variant
atggcgcttttatctcattactttgagagccatcaccagcgactatgtcgtatgggtaaagcgcttatttatcggagagaaataccgataaataagaagcatcaaag

SEQ ID NO: 2541 - DNA, 106 bp, Artificial Sequence
  scaffold variant
tactggcgcttttatctcattactttgagagccatcaccagcgactatgtcgtatgggtaaagcgcttatttacggagagaaatcgataaataagaagcatcaaag

SEQ ID NO: 2542 - DNA, 106 bp, Artificial Sequence
  scaffold variant
gctggcgcttttatctcattactttgagagccatcaccagcgactatgtcgtatgggtaaagcgcttatttatcggaggaaatccgataaataagaagcatcaaag

SEQ ID NO: 2543 - DNA, 105 bp, Artificial Sequence; identical to SEQ ID NO: 557
  scaffold variant

SEQ ID NO: 2544 - DNA, 107 bp, Artificial Sequence; identical to SEQ ID NO: 1142
  scaffold variant

SEQ ID NO: 2545 - DNA, 109 bp, Artificial Sequence; identical to SEQ ID NO: 955
  scaffold variant

SEQ ID NO: 2546 - DNA, 107 bp, Artificial Sequence; identical to SEQ ID NO: 1736
  scaffold variant

SEQ ID NO: 2547 - DNA, 109 bp, Artificial Sequence; identical to SEQ ID NO: 993
  scaffold variant

SEQ ID NO: 2548 - DNA, 109 bp, Artificial Sequence; identical to SEQ ID NO: 1093
  scaffold variant

SEQ ID NO: 2549 - DNA, 107 bp, Artificial Sequence; identical to SEQ ID NO: 1752
  scaffold variant

SEQ ID NO: 2550 - DNA, 109 bp, Artificial Sequence; identical to SEQ ID NO: 1190
  scaffold variant

SEQ ID NO: 2551 - DNA, 107 bp, Artificial Sequence; identical to SEQ ID NO: 1736
  scaffold variant

SEQ ID NO: 2552 - DNA, 106 bp, Artificial Sequence
  scaffold variant
tctggcgcttttattcattactttgagagccatcaccagcgactatgtcgtatgggtaaagcgcttatttatcggagagaaatccgataaataagaagcatcaaag

SEQ ID NO: 2553 - DNA, 107 bp, Artificial Sequence
  scaffold variant
tactggcgcttttatcttattactttgagagccatcaccagcgactatgtcgtatgggtaaagcgcttatttatcgagagaaatccgataaataagaagcatcaaag

SEQ ID NO: 2554 - DNA, 107 bp, Artificial Sequence; identical to SEQ ID NO: 1136
  scaffold variant

SEQ ID NO: 2555 - DNA, 106 bp, Artificial Sequence
  scaffold variant
tactggcgcttttatctcattactttgagagccatcaccagcgactatgtcgtatgggtaaagcggtatttatcggagagtatccgataaataagaagcatcaaag

SEQ ID NO: 2556 - DNA, 106 bp, Artificial Sequence
  scaffold variant
gctggcgcttttatctcattactttgagagccatcaccagcgactatgtcgtatgggtaaagcgcttatttatcggagagcatccgataaataagaagcatcaaag

SEQ ID NO: 2557 - DNA, 107 bp, Artificial Sequence
  scaffold variant
tctggcgcttttattctcattactttgagagccatcaccagcgactatgtcgtatgggtaaagcgcttatttatcgagagaaatccgataaataagaagcatcaaag

SEQ ID NO: 2558 - DNA, 108 bp, Artificial Sequence
  scaffold variant
tactggcgcttttatctcattactttgagagccatcaccagcgactatgtcgtatgggtaaagcgcttatttatcgggagagaaatcgataaataagaagcatcaaag

SEQ ID NO: 2559 - DNA, 106 bp, Artificial Sequence; identical to SEQ ID NO: 907
  scaffold variant

SEQ ID NO: 2560 - DNA, 107 bp, Artificial Sequence; identical to SEQ ID NO: 878
  scaffold variant

SEQ ID NO: 2561 - DNA, 107 bp, Artificial Sequence; identical to SEQ ID NO: 1960
  scaffold variant

SEQ ID NO: 2562 - DNA, 107 bp, Artificial Sequence; identical to SEQ ID NO: 1960
  scaffold variant

SEQ ID NO: 2563 - DNA, 106 bp, Artificial Sequence
  scaffold variant
tactggcgcttttatctcattactttgagagccatcaccagcgactatgtcgtatgggtaaagcgcttattttcggagagaaatccataaataagaagcatcaaag

SEQ ID NO: 2564 - DNA, 109 bp, Artificial Sequence; identical to SEQ ID NO: 785
  scaffold variant

SEQ ID NO: 2565 - DNA, 107 bp, Artificial Sequence; identical to SEQ ID NO: 1736
  scaffold variant

SEQ ID NO: 2566 - DNA, 107 bp, Artificial Sequence; identical to SEQ ID NO: 1035
  scaffold variant

SEQ ID NO: 2567 - DNA, 107 bp, Artificial Sequence; identical to SEQ ID NO: 1960
  scaffold variant

SEQ ID NO: 2568 - DNA, 109 bp, Artificial Sequence; identical to SEQ ID NO: 957
  scaffold variant

SEQ ID NO: 2569 - DNA, 109 bp, Artificial Sequence; identical to SEQ ID NO: 1222
  scaffold variant

SEQ ID NO: 2570 - DNA, 106 bp, Artificial Sequence; identical to SEQ ID NO: 663
  scaffold variant

SEQ ID NO: 2571 - DNA, 109 bp, Artificial Sequence; identical to SEQ ID NO: 1228
  scaffold variant

SEQ ID NO: 2572 - DNA, 106 bp, Artificial Sequence; identical to SEQ ID NO: 504
  scaffold variant

SEQ ID NO: 2573 - DNA, 107 bp, Artificial Sequence; identical to SEQ ID NO: 1263
  scaffold variant

SEQ ID NO: 2574 - DNA, 106 bp, Artificial Sequence; identical to SEQ ID NO: 782
  scaffold variant

SEQ ID NO: 2575 - DNA, 106 bp, Artificial Sequence
  scaffold variant
tactggcgcttttatctcattactttgagagccatcaccagcgactatgtcgtatgggtaaagcggtatttatcggaggaaatccgataaataagaagcatcaaag

SEQ ID NO: 2576 - DNA, 106 bp, Artificial Sequence; identical to SEQ ID NO: 1829
  scaffold variant

SEQ ID NO: 2577 - DNA, 107 bp, Artificial Sequence; identical to SEQ ID NO: 1471
  scaffold variant

SEQ ID NO: 2578 - DNA, 107 bp, Artificial Sequence; identical to SEQ ID NO: 1142
  scaffold variant

SEQ ID NO: 2579 - DNA, 108 bp, Artificial Sequence
  scaffold variant
tactggcgcttttatcctcattactttgagagccatcaccagcgactatgtcgtatgggtaaagcgcttatttatcggagaaaatccgataaataagaagcatcaaag

SEQ ID NO: 2580 - DNA, 107 bp, Artificial Sequence; identical to SEQ ID NO: 1307
  scaffold variant

SEQ ID NO: 2581 - DNA, 107 bp, Artificial Sequence; identical to SEQ ID NO: 1017
  scaffold variant

SEQ ID NO: 2582 - DNA, 108 bp, Artificial Sequence
  scaffold variant
tactggcgcttttatctcattactttgagagccatcaccagcgactatgtcgtatgggtaaagcgcttattttcggagagaaatcacgataaataagaagcatcaaag

SEQ ID NO: 2583 - DNA, 108 bp, Artificial Sequence
  scaffold variant
tactggcgcttttatctcattactttgagagccatcaccagcgactatgtcgtatgggtaaagcgatatttatcgggagagaaatccgataaataagaagcatcaaag

SEQ ID NO: 2584 - DNA, 108 bp, Artificial Sequence
  scaffold variant
tactggcgcttttatctctattactttgagagccatcaccagcgactatgtcgtatgggtaaagcgcttatttccggagagaaatccgataaataagaagcatcaaag

SEQ ID NO: 2585 - DNA, 109 bp, Artificial Sequence; identical to SEQ ID NO: 882
  scaffold variant

SEQ ID NO: 2586 - DNA, 107 bp, Artificial Sequence; identical to SEQ ID NO: 1960
  scaffold variant

SEQ ID NO: 2587 - DNA, 110 bp, Artificial Sequence
  scaffold variant
tactggcgcttttattctcattactttgagagccatcaccagcgactatgtcgtatgggtaaagcgcttatcttatcggagagaaatccgataaataagaagcatcaaag

SEQ ID NO: 2588 - DNA, 106 bp, Artificial Sequence
  scaffold variant
tctggcgcttttatctattactttgagagccatcaccagcgactatgtcgtatgggtaaagcgcttatttatcggagagaaatccgataaataagaagcatcaaag

SEQ ID NO: 2589 - DNA, 109 bp, Artificial Sequence; identical to SEQ ID NO: 992
  scaffold variant

SEQ ID NO: 2590 - DNA, 109 bp, Artificial Sequence; identical to SEQ ID NO: 563
  scaffold variant

SEQ ID NO: 2591 - DNA, 107 bp, Artificial Sequence; identical to SEQ ID NO: 1307
  scaffold variant

SEQ ID NO: 2592 - DNA, 107 bp, Artificial Sequence; identical to SEQ ID NO: 1307
  scaffold variant

SEQ ID NO: 2593 - DNA, 107 bp, Artificial Sequence; identical to SEQ ID NO: 1960
  scaffold variant

SEQ ID NO: 2594 - DNA, 110 bp, Artificial Sequence
  scaffold variant
ctactggcgcttttatctcattactttgagagccatcaccagcgactatgtcgtatgggtaaagcgcttatttactcggagagaaatccgataaataagaagcatcaaag

SEQ ID NO: 2595 - DNA, 109 bp, Artificial Sequence
  scaffold variant
tactggcgcctttatctcattactttgagagccatcaccagcgactatgtcgtatgggtaaagcgcttatttatcggagagaaatcgcgataaataagaagcatcaaag

SEQ ID NO: 2596 - DNA, 106 bp, Artificial Sequence; identical to SEQ ID NO: 504
  scaffold variant

SEQ ID NO: 2597 - DNA, 109 bp, Artificial Sequence; identical to SEQ ID NO: 1093
  scaffold variant

SEQ ID NO: 2598 - DNA, 106 bp, Artificial Sequence; identical to SEQ ID NO: 1979
  scaffold variant

SEQ ID NO: 2599 - DNA, 108 bp, Artificial Sequence
  scaffold variant
tactggcgcttttatctcattactttgagagccatcaccagcgactatgtcgtatgggtaaagcgcttattctatcggagagaatccgataaataagaagcatcaaag

SEQ ID NO: 2600 - DNA, 110 bp, Artificial Sequence
  scaffold variant
atactggcgcttttatctcattactttgagagccatcaccagcgactatgtcgtatgggtaaagcgcttatttatcggcagagaaatccgataaataagaagcatcaaag

SEQ ID NO: 2601 - DNA, 108 bp, Artificial Sequence
  scaffold variant
tactggcgcttttatctcattactttgagagccatcaccagcgactatgtcgtatgggtaaagcgcttatttatacggagagaatccgataaataagaagcatcaaag

SEQ ID NO: 2602 - DNA, 108 bp, Artificial Sequence; identical to SEQ ID NO: 450
  scaffold variant

SEQ ID NO: 2603 - DNA, 107 bp, Artificial Sequence; identical to SEQ ID NO: 960
  scaffold variant

SEQ ID NO: 2604 - DNA, 108 bp, Artificial Sequence
  scaffold variant
tactggcgcttttatctcattactttgagagccatcaccagcgactatgtcgtatgggtaaagcgcttatttatgcggagagaaatccgatgataagaagcatcaaag

SEQ ID NO: 2605 - DNA, 107 bp, Artificial Sequence; identical to SEQ ID NO: 1509
  scaffold variant

SEQ ID NO: 2606 - DNA, 108 bp, Artificial Sequence
  scaffold variant
tactggcgcttttatcctcattactttgagagccatcaccagcgactatgtcgtatgggtaaagcgcttatttatcgtgagaaatccgataaataagaagcatcaaag

SEQ ID NO: 2607 - DNA, 107 bp, Artificial Sequence; identical to SEQ ID NO: 1081
  scaffold variant

SEQ ID NO: 2608 - DNA, 107 bp, Artificial Sequence
  scaffold variant
tactggcgcttttatctcattactttgagagccatcaccagcgactatgtcgtatgggtaaagcgcttatttatcggtagaaatccgataaataagaagcatcaaag

SEQ ID NO: 2609 - DNA, 107 bp, Artificial Sequence; identical to SEQ ID NO: 1142
  scaffold variant

SEQ ID NO: 2610 - DNA, 107 bp, Artificial Sequence; identical to SEQ ID NO: 1752
  scaffold variant

SEQ ID NO: 2611 - DNA, 108 bp, Artificial Sequence
  scaffold variant
tctggcgcttttatcatcattactttgagagccatcaccagcgactatgtcgtatgggtaaagcgcttatttatcggagagaaatccgataaataagaagcatcaaag

SEQ ID NO: 2612 - DNA, 109 bp, Artificial Sequence; identical to SEQ ID NO: 1025
  scaffold variant

SEQ ID NO: 2613 - DNA, 107 bp, Artificial Sequence; identical to SEQ ID NO: 1057
  scaffold variant

SEQ ID NO: 2614 - DNA, 110 bp, Artificial Sequence
  scaffold variant
tactggcgcttttatcatcattactttgagagccatcaccagcgactatgtcgtatgggtaaagcgcttatttatcggcagagaaatccgataaataagaagcatcaaag

SEQ ID NO: 2615 - DNA, 107 bp, Artificial Sequence; identical to SEQ ID NO: 1081
  scaffold variant

SEQ ID NO: 2616 - DNA, 107 bp, Artificial Sequence; identical to SEQ ID NO: 960
  scaffold variant

SEQ ID NO: 2617 - DNA, 109 bp, Artificial Sequence
  scaffold variant
tactggcgcttttatctcattactttgagagccatcaccagcgactatgtcgtatgggtaaagcgcttattatatcggagagaaatccgataaataagaagcatcaaag

SEQ ID NO: 2618 - DNA, 107 bp, Artificial Sequence; identical to SEQ ID NO: 1382
  scaffold variant

SEQ ID NO: 2619 - DNA, 107 bp, Artificial Sequence; identical to SEQ ID NO: 1471
  scaffold variant

SEQ ID NO: 2620 - DNA, 106 bp, Artificial Sequence
  scaffold variant
tactggcgcttttatctcattactttgagagccatcaccagcgactatgtcgtatgggtaaagcggtatttatcggagagaaatccgtaaataagaagcatcaaag

SEQ ID NO: 2621 - DNA, 110 bp, Artificial Sequence
  scaffold variant
ctactggcgcttttatctcattactttgagagccatcaccagcgactatgtcgtatgggtaaagcgcttatttatcgcgagagaaatccgataaataagaagcatcaaag

SEQ ID NO: 2622 - DNA, 107 bp, Artificial Sequence; identical to SEQ ID NO: 878
  scaffold variant

SEQ ID NO: 2623 - DNA, 109 bp, Artificial Sequence; identical to SEQ ID NO: 563
  scaffold variant

SEQ ID NO: 2624 - DNA, 110 bp, Artificial Sequence
  scaffold variant
tactggcgcttttatctcattactttgagagccatcaccagcgactatgtcgtatgggtaaagcgcttatttattcggagagaaatctcgataaataagaagcatcaaag

SEQ ID NO: 2625 - DNA, 110 bp, Artificial Sequence
  scaffold variant
tactggcgcttttatcctcattactttgagagccatcaccagcgactatgtcgtatgggtaaagcgcttatttatcggagagaaatccgataaataagagagcatcaaag

SEQ ID NO: 2626 - DNA, 108 bp, Artificial Sequence; identical to SEQ ID NO: 450
  scaffold variant

SEQ ID NO: 2627 - DNA, 109 bp, Artificial Sequence; identical to SEQ ID NO: 1025
  scaffold variant

SEQ ID NO: 2628 - DNA, 107 bp, Artificial Sequence; identical to SEQ ID NO: 878
  scaffold variant

SEQ ID NO: 2629 - DNA, 106 bp, Artificial Sequence
  scaffold variant
ctggcgcttttatcccattactttgagagccatcaccagcgactatgtcgtatgggtaaagcgcttatttatcggagagaaatccgataaataagaagcatcaaag

SEQ ID NO: 2630 - DNA, 109 bp, Artificial Sequence; identical to SEQ ID NO: 563
  scaffold variant

SEQ ID NO: 2631 - DNA, 107 bp, Artificial Sequence; identical to SEQ ID NO: 1081
  scaffold variant

SEQ ID NO: 2632 - DNA, 106 bp, Artificial Sequence; identical to SEQ ID NO: 1979
  scaffold variant

SEQ ID NO: 2633 - DNA, 109 bp, Artificial Sequence; identical to SEQ ID NO: 1600
  scaffold variant

SEQ ID NO: 2634 - DNA, 109 bp, Artificial Sequence
  scaffold variant
tactggcgcttttatctaattactttgagagccatcaccagcgactatgtcgtatgggtaaagcgcttatttatccggagagaaatccgataaataagaagcatcaaag

SEQ ID NO: 2635 - DNA, 107 bp, Artificial Sequence; identical to SEQ ID NO: 1017
  scaffold variant

SEQ ID NO: 2636 - DNA, 107 bp, Artificial Sequence; identical to SEQ ID NO: 1307
  scaffold variant

SEQ ID NO: 2637 - DNA, 107 bp, Artificial Sequence; identical to SEQ ID NO: 1960
  scaffold variant

SEQ ID NO: 2638 - DNA, 106 bp, Artificial Sequence
  scaffold variant
actggcgcttttatctcattactttgagagccatcaccagcgactatgtcgtatgggtaaagcgcttatttatcggagacaatccgataaataagaagcatcaaag

SEQ ID NO: 2639 - DNA, 107 bp, Artificial Sequence; identical to SEQ ID NO: 1307
  scaffold variant

SEQ ID NO: 2640 - DNA, 107 bp, Artificial Sequence; identical to SEQ ID NO: 1307
  scaffold variant

SEQ ID NO: 2641 - DNA, 109 bp, Artificial Sequence; identical to SEQ ID NO: 1025
  scaffold variant

SEQ ID NO: 2642 - DNA, 107 bp, Artificial Sequence; identical to SEQ ID NO: 970
  scaffold variant

SEQ ID NO: 2643 - DNA, 107 bp, Artificial Sequence; identical to SEQ ID NO: 1723
  scaffold variant

SEQ ID NO: 2644 - DNA, 107 bp, Artificial Sequence; identical to SEQ ID NO: 1382
  scaffold variant

SEQ ID NO: 2645 - DNA, 107 bp, Artificial Sequence; identical to SEQ ID NO: 960
  scaffold variant

SEQ ID NO: 2646 - DNA, 109 bp, Artificial Sequence; identical to SEQ ID NO: 992
  scaffold variant

SEQ ID NO: 2647 - DNA, 109 bp, Artificial Sequence; identical to SEQ ID NO: 785
  scaffold variant

SEQ ID NO: 2648 - DNA, 107 bp, Artificial Sequence; identical to SEQ ID NO: 1263
  scaffold variant

SEQ ID NO: 2649 - DNA, 107 bp, Artificial Sequence; identical to SEQ ID NO: 1136
  scaffold variant

SEQ ID NO: 2650 - DNA, 105 bp, Artificial Sequence; identical to SEQ ID NO: 435
  scaffold variant

SEQ ID NO: 2651 - DNA, 108 bp, Artificial Sequence; identical to SEQ ID NO: 894
  scaffold variant

SEQ ID NO: 2652 - DNA, 107 bp, Artificial Sequence; identical to SEQ ID NO: 1017
  scaffold variant

SEQ ID NO: 2653 - DNA, 108 bp, Artificial Sequence; identical to SEQ ID NO: 814
  scaffold variant

SEQ ID NO: 2654 - DNA, 109 bp, Artificial Sequence; identical to SEQ ID NO: 1025
  scaffold variant

SEQ ID NO: 2655 - DNA, 108 bp, Artificial Sequence; identical to SEQ ID NO: 487
  scaffold variant

SEQ ID NO: 2656 - DNA, 109 bp, Artificial Sequence
  scaffold variant
cactggcgcttttatctcattactttgagagccatcaccagcgactatgtcgtatgggtaaagcgcttatttatcgggagagaaatccgataaataagaagcatcaaag

SEQ ID NO: 2657 - DNA, 108 bp, Artificial Sequence
  scaffold variant
tactggcgcttttatctcattactttgagagccatcaccagcgactatgtcgtatgggtaaagcgcttattttcggagagaaatccgataaataagaaagcatcaaag

SEQ ID NO: 2658 - DNA, 109 bp, Artificial Sequence; identical to SEQ ID NO: 1831
  scaffold variant

SEQ ID NO: 2659 - DNA, 107 bp, Artificial Sequence; identical to SEQ ID NO: 1960
  scaffold variant

SEQ ID NO: 2660 - DNA, 107 bp, Artificial Sequence; identical to SEQ ID NO: 1035
  scaffold variant

SEQ ID NO: 2661 - DNA, 106 bp, Artificial Sequence
  scaffold variant
gatggcgcttttatctcattactttgagagccatcaccagcgactatgtcgtatgggtaaagcgcttatttacggagagaaatccgataaataagaagcatcaaag

SEQ ID NO: 2662 - DNA, 108 bp, Artificial Sequence
  scaffold variant
taactggcgcttttatctcattactttgagagccatcaccagcgactatgtcgtatgggtaaagcgcttatttatctagagaaatccgataaataagaagcatcaaag

SEQ ID NO: 2663 - DNA, 108 bp, Artificial Sequence
  scaffold variant
tactggcgcttttatctcattactttgagagccatcaccagcgactatgtcgtatgggtaaagcgcttatttattcggagagtatccgataaataagaagcatcaaag

SEQ ID NO: 2664 - DNA, 110 bp, Artificial Sequence
  scaffold variant
tactggcgcttttatctcattactttgagagccatcaccagcgactatgtcgtatgggtaaagcgcttatttagtcggagagaaatccgaataaataagaagcatcaaag

SEQ ID NO: 2665 - DNA, 107 bp, Artificial Sequence; identical to SEQ ID NO: 960
  scaffold variant

SEQ ID NO: 2666 - DNA, 108 bp, Artificial Sequence
  scaffold variant
tactggcgcttttatctcattactttgagagccatcaccagcgactatgtcgtatgggtaaagcgcttatttatctggagagaaatcgataaataagaagcatcaaag

SEQ ID NO: 2667 - DNA, 107 bp, Artificial Sequence; identical to SEQ ID NO: 2458
  scaffold variant

SEQ ID NO: 2668 - DNA, 107 bp, Artificial Sequence; identical to SEQ ID NO: 1035
  scaffold variant

SEQ ID NO: 2669 - DNA, 109 bp, Artificial Sequence; identical to SEQ ID NO: 1093
  scaffold variant

SEQ ID NO: 2670 - DNA, 107 bp, Artificial Sequence
  scaffold variant
cctggcgcttttatctcattactttgagagccatcaccagcgactatgtcgtatgggtaaagcgcttatttataggagagaaatccgataaataagaagcatcaaag

SEQ ID NO: 2671 - DNA, 109 bp, Artificial Sequence
  scaffold variant
tactggcgcttttatctcattactttgagagccatcaccagcgactatgtcgtatgggtaaagcgcttatttatgcggagagaaatccggtaaataagaagcatcaaag

SEQ ID NO: 2672 - DNA, 109 bp, Artificial Sequence; identical to SEQ ID NO: 1190
  scaffold variant

SEQ ID NO: 2673 - DNA, 109 bp, Artificial Sequence; identical to SEQ ID NO: 957
  scaffold variant

SEQ ID NO: 2674 - DNA, 109 bp, Artificial Sequence; identical to SEQ ID NO: 1600
  scaffold variant

SEQ ID NO: 2675 - DNA, 107 bp, Artificial Sequence; identical to SEQ ID NO: 1263
  scaffold variant

SEQ ID NO: 2676 - DNA, 107 bp, Artificial Sequence
  scaffold variant
tactggcgcttttatcttcattactttgagagccatcaccagcgactatgtcgtatgggtaaagcgcttatttatcggggaaatccgataaataagaagcatcaaag

SEQ ID NO: 2677 - DNA, 109 bp, Artificial Sequence; identical to SEQ ID NO: 1055
  scaffold variant

SEQ ID NO: 2678 - DNA, 108 bp, Artificial Sequence; identical to SEQ ID NO: 618
  scaffold variant

SEQ ID NO: 2679 - DNA, 110 bp, Artificial Sequence
  scaffold variant
ctactggcgcttttatctcattactttgagagccatcaccagcgactatgtcgtatgggtaaagcgcttatttatcgagagagaaatccgataaataagaagcatcaaag

SEQ ID NO: 2680 - DNA, 108 bp, Artificial Sequence; identical to SEQ ID NO: 535
  scaffold variant

SEQ ID NO: 2681 - DNA, 107 bp, Artificial Sequence; identical to SEQ ID NO: 1889
  scaffold variant

SEQ ID NO: 2682 - DNA, 107 bp, Artificial Sequence; identical to SEQ ID NO: 878
  scaffold variant

SEQ ID NO: 2683 - DNA, 107 bp, Artificial Sequence; identical to SEQ ID NO: 1802
  scaffold variant

SEQ ID NO: 2684 - DNA, 109 bp, Artificial Sequence; identical to SEQ ID NO: 1062
  scaffold variant

SEQ ID NO: 2685 - DNA, 106 bp, Artificial Sequence; identical to SEQ ID NO: 416
  scaffold variant

SEQ ID NO: 2686 - DNA, 106 bp, Artificial Sequence; identical to SEQ ID NO: 508
  scaffold variant

SEQ ID NO: 2687 - DNA, 107 bp, Artificial Sequence; identical to SEQ ID NO: 1142
  scaffold variant

SEQ ID NO: 2688 - DNA, 107 bp, Artificial Sequence; identical to SEQ ID NO: 1307
  scaffold variant

SEQ ID NO: 2689 - DNA, 106 bp, Artificial Sequence
  scaffold variant
tctggcgcttttatctcattactttgagagccatcaccagcgactatgtcgtatgggtaaagcgcttatttatcggagagattccgataaataagaagcatcaaag

SEQ ID NO: 2690 - DNA, 109 bp, Artificial Sequence
  scaffold variant
tactggcgcttttatctcattactttgagagccatcaccagcgactatgtcgtatgggtaaagcgcttatttatcgggagggaaatccgataaataagaagcatcaaag

SEQ ID NO: 2691 - DNA, 106 bp, Artificial Sequence; identical to SEQ ID NO: 1979
  scaffold variant

SEQ ID NO: 2692 - DNA, 110 bp, Artificial Sequence
  scaffold variant
tactggcgcttttatctcattactttgagagccatcaccagcgactatgtcgtatgggtaaagcgcttattgtatcggagagaaatcgcgataaataagaagcatcaaag

SEQ ID NO: 2693 - DNA, 107 bp, Artificial Sequence; identical to SEQ ID NO: 1723
  scaffold variant

SEQ ID NO: 2694 - DNA, 109 bp, Artificial Sequence; identical to SEQ ID NO: 957
  scaffold variant

SEQ ID NO: 2695 - DNA, 108 bp, Artificial Sequence
  scaffold variant
ttactggcgcttttatctcattactttgagagccatcaccagcgactatgtcgtatgggtaaagcgcttatttgcggagagaaatccgataaataagaagcatcaaag

SEQ ID NO: 2696 - DNA, 107 bp, Artificial Sequence
  scaffold variant
tacggcgcttttatctcattactttgagagccatcaccagcgactatgtcgtatgggtaaagcgcttatctatcggagagaaatccgataaataagaagcatcaaag

SEQ ID NO: 2697 - DNA, 107 bp, Artificial Sequence; identical to SEQ ID NO: 1927
  scaffold variant

SEQ ID NO: 2698 - DNA, 107 bp, Artificial Sequence; identical to SEQ ID NO: 1081
  scaffold variant

SEQ ID NO: 2699 - DNA, 107 bp, Artificial Sequence; identical to SEQ ID NO: 1889
  scaffold variant

SEQ ID NO: 2700 - DNA, 108 bp, Artificial Sequence
  scaffold variant
tactggcgcttttatctcattactttgagagccatcaccagcgactatgtcgtatgggtaaagcgcttatttatcaagagaaatccgataaataagaaagcatcaaag

SEQ ID NO: 2701 - DNA, 107 bp, Artificial Sequence; identical to SEQ ID NO: 878
  scaffold variant

SEQ ID NO: 2702 - DNA, 110 bp, Artificial Sequence
  scaffold variant
tactggcgcttttatctcattactttgagagccatcaccagcgactatgtcgtatgggtaaagcgcttatttatccggagagaaatgccgataaataagaagcatcaaag

SEQ ID NO: 2703 - DNA, 108 bp, Artificial Sequence; identical to SEQ ID NO: 814
  scaffold variant

SEQ ID NO: 2704 - DNA, 109 bp, Artificial Sequence; identical to SEQ ID NO: 957
  scaffold variant

SEQ ID NO: 2705 - DNA, 109 bp, Artificial Sequence; identical to SEQ ID NO: 1228
  scaffold variant

SEQ ID NO: 2706 - DNA, 107 bp, Artificial Sequence
  scaffold variant
cctggcgcttttatctcattactttgagagccatcaccagcgactatgtcgtatgggtaaagctcttatttatcggagagaaatccgataaataagaagcatcaaag

SEQ ID NO: 2707 - DNA, 109 bp, Artificial Sequence; identical to SEQ ID NO: 847
  scaffold variant

SEQ ID NO: 2708 - DNA, 107 bp, Artificial Sequence; identical to SEQ ID NO: 1136
  scaffold variant

SEQ ID NO: 2709 - DNA, 110 bp, Artificial Sequence
  scaffold variant
tactggcgcttttatctcattactttgagagccatcaccagcgactatgtcgtatgggtaaagcgcttattctatcggagagaaatcgcgataaataagaagcatcaaag

SEQ ID NO: 2710 - DNA, 107 bp, Artificial Sequence; identical to SEQ ID NO: 1307
  scaffold variant

SEQ ID NO: 2711 - DNA, 109 bp, Artificial Sequence
  scaffold variant
tactggcgcttttatctcattactttgagagccatcaccagcgactatgtcgtatgggtaaagcgcttattttatcggagagaaatccgataaataagaagcatcaaag

SEQ ID NO: 2712 - DNA, 106 bp, Artificial Sequence; identical to SEQ ID NO: 430
  scaffold variant

SEQ ID NO: 2713 - DNA, 109 bp, Artificial Sequence; identical to SEQ ID NO: 785
  scaffold variant

SEQ ID NO: 2714 - DNA, 104 bp, Artificial Sequence
  scaffold variant
atggcgcttttatctcattactttgagagccatcaccagcgactatgtcgtatgggtaaagcgcttatttatcggagagatccgataaataagaagcatcaaag

SEQ ID NO: 2715 - DNA, 106 bp, Artificial Sequence; identical to SEQ ID NO: 1829
  scaffold variant

SEQ ID NO: 2716 - DNA, 107 bp, Artificial Sequence; identical to SEQ ID NO: 1802
  scaffold variant

SEQ ID NO: 2717 - DNA, 109 bp, Artificial Sequence; identical to SEQ ID NO: 1164
  scaffold variant

SEQ ID NO: 2718 - DNA, 107 bp, Artificial Sequence; identical to SEQ ID NO: 1017
  scaffold variant

SEQ ID NO: 2719 - DNA, 109 bp, Artificial Sequence; identical to SEQ ID NO: 847
  scaffold variant

SEQ ID NO: 2720 - DNA, 110 bp, Artificial Sequence
  scaffold variant
tactggcgcttttatctcattactttgagagccatcaccagcgactatgtcgtatgggtaaagcgcttatttatctggagagaaatcccgataaataagaagcatcaaag

SEQ ID NO: 2721 - DNA, 107 bp, Artificial Sequence; identical to SEQ ID NO: 1017
  scaffold variant

SEQ ID NO: 2722 - DNA, 107 bp, Artificial Sequence; identical to SEQ ID NO: 1752
  scaffold variant

SEQ ID NO: 2723 - DNA, 109 bp, Artificial Sequence; identical to SEQ ID NO: 1600
  scaffold variant

SEQ ID NO: 2724 - DNA, 109 bp, Artificial Sequence; identical to SEQ ID NO: 847
  scaffold variant

SEQ ID NO: 2725 - DNA, 107 bp, Artificial Sequence; identical to SEQ ID NO: 1142
  scaffold variant

SEQ ID NO: 2726 - DNA, 107 bp, Artificial Sequence
  scaffold variant
cctggcgctcttatctcattactttgagagccatcaccagcgactatgtcgtatgggtaaagcgcttatttatcggagagaaatccgataaataagaagcatcaaag

SEQ ID NO: 2727 - DNA, 107 bp, Artificial Sequence; identical to SEQ ID NO: 1136
  scaffold variant

SEQ ID NO: 2728 - DNA, 107 bp, Artificial Sequence; identical to SEQ ID NO: 878
  scaffold variant

SEQ ID NO: 2729 - DNA, 106 bp, Artificial Sequence; identical to SEQ ID NO: 474
  scaffold variant

SEQ ID NO: 2730 - DNA, 109 bp, Artificial Sequence; identical to SEQ ID NO: 847
  scaffold variant

SEQ ID NO: 2731 - DNA, 108 bp, Artificial Sequence
  scaffold variant
tactggcgcttttatctcattactttgagagccatcaccagcgactatgtcgtatgggtaaagcgatatttatcggagagaaatcccgataaataagaagcatcaaag

SEQ ID NO: 2732 - DNA, 107 bp, Artificial Sequence; identical to SEQ ID NO: 878
  scaffold variant

SEQ ID NO: 2733 - DNA, 108 bp, Artificial Sequence
  scaffold variant
tactggcgcttttatctcattactttgagagccatcaccagcgactatgtcgtatgggtaaagcgcttatttatcgggagaaatccgataaataagagagcatcaaag

SEQ ID NO: 2734 - DNA, 107 bp, Artificial Sequence
  scaffold variant
tactggcgcttttatctcattactttgagagccatcaccagcgactatgtcgtatgggtaaagcgcttatttatcggagtaaatccgataaataagaagcatcaaag

SEQ ID NO: 2735 - DNA, 106 bp, Artificial Sequence; identical to SEQ ID NO: 577
  scaffold variant

SEQ ID NO: 2736 - DNA, 108 bp, Artificial Sequence
  scaffold variant
tactggcgcttttatctcattactttgagagccatcaccagcgactatgtcgtatgggtaaagcggtatttatgcggagagaaatccgataaataagaagcatcaaag

SEQ ID NO: 2737 - DNA, 109 bp, Artificial Sequence; identical to SEQ ID NO: 1055
  scaffold variant

SEQ ID NO: 2738 - DNA, 107 bp, Artificial Sequence
  scaffold variant
cctggcgcttttatctcataactttgagagccatcaccagcgactatgtcgtatgggtaaagcgcttatttatcggagagaaatccgataaataagaagcatcaaag

SEQ ID NO: 2739 - DNA, 107 bp, Artificial Sequence; identical to SEQ ID NO: 1723
  scaffold variant

SEQ ID NO: 2740 - DNA, 108 bp, Artificial Sequence
  scaffold variant
atactggcgcttttatctcattactttgagagccatcaccagcgactatgtcgtatgggtaaagcgcttatttatcgggagaaatccgataaataagaagcatcaaag

SEQ ID NO: 2741 - DNA, 109 bp, Artificial Sequence; identical to SEQ ID NO: 1025
  scaffold variant

SEQ ID NO: 2742 - DNA, 107 bp, Artificial Sequence
  scaffold variant
ccttgcgcttttatctcattactttgagagccatcaccagcgactatgtcgtatgggtaaagcgcttatttatcggagagaaatccgataaataagaagcatcaaag

SEQ ID NO: 2743 - DNA, 107 bp, Artificial Sequence; identical to SEQ ID NO: 1136
  scaffold variant

SEQ ID NO: 2744 - DNA, 108 bp, Artificial Sequence
  scaffold variant
cctggcgcttttatctcattactttgagagccatcaccagcgactatgtcgtatgggtaaagcgcttatttatcggagagaaatccgataaataagaagcatcaaagc

SEQ ID NO: 2745 - DNA, 107 bp, Artificial Sequence; identical to SEQ ID NO: 1960
  scaffold variant

SEQ ID NO: 2746 - DNA, 108 bp, Artificial Sequence; identical to SEQ ID NO: 487
  scaffold variant

SEQ ID NO: 2747 - DNA, 107 bp, Artificial Sequence; identical to SEQ ID NO: 1017
  scaffold variant

SEQ ID NO: 2748 - DNA, 106 bp, Artificial Sequence; identical to SEQ ID NO: 1829
  scaffold variant

SEQ ID NO: 2749 - DNA, 109 bp, Artificial Sequence
  scaffold variant
tactggcgcttttatctcattactttgagagccatcaccagcgactatgtcgtatgggtaaagcgcttatttatcggagagaaatccgataaataagagagcatcaaag

SEQ ID NO: 2750 - DNA, 107 bp, Artificial Sequence; identical to SEQ ID NO: 1263
  scaffold variant

SEQ ID NO: 2751 - DNA, 109 bp, Artificial Sequence; identical to SEQ ID NO: 1241
  scaffold variant

SEQ ID NO: 2752 - DNA, 107 bp, Artificial Sequence; identical to SEQ ID NO: 1802
  scaffold variant

SEQ ID NO: 2753 - DNA, 107 bp, Artificial Sequence; identical to SEQ ID NO: 1017
  scaffold variant

SEQ ID NO: 2754 - DNA, 107 bp, Artificial Sequence; identical to SEQ ID NO: 1752
  scaffold variant

SEQ ID NO: 2755 - DNA, 109 bp, Artificial Sequence; identical to SEQ ID NO: 986
  scaffold variant

SEQ ID NO: 2756 - DNA, 107 bp, Artificial Sequence; identical to SEQ ID NO: 1017
  scaffold variant

SEQ ID NO: 2757 - DNA, 107 bp, Artificial Sequence; identical to SEQ ID NO: 1035
  scaffold variant

SEQ ID NO: 2758 - DNA, 106 bp, Artificial Sequence; identical to SEQ ID NO: 514
  scaffold variant

SEQ ID NO: 2759 - DNA, 108 bp, Artificial Sequence
  scaffold variant
tactggcgcttttatctcattactttgagagccatcaccagcgactatgtcgtatgggtaaagcgcttatttatccggagagaaatccgatgataagaagcatcaaag

SEQ ID NO: 2760 - DNA, 106 bp, Artificial Sequence; identical to SEQ ID NO: 1280
  scaffold variant

SEQ ID NO: 2761 - DNA, 108 bp, Artificial Sequence
  scaffold variant
tactggcgcttttatctcattactttgagagccatcaccagcgactatgtcgtatgggtaaagcgcttatttatccggagagaaatccgatagtaagaagcatcaaag

SEQ ID NO: 2762 - DNA, 107 bp, Artificial Sequence
  scaffold variant
tactggcgcttttatctaattactttgagagccatcaccagcgactatgtcgtatgggtaaagcgcttatttatcgggagaaatccgataaataagaagcatcaaag

SEQ ID NO: 2763 - DNA, 109 bp, Artificial Sequence; identical to SEQ ID NO: 1055
  scaffold variant

SEQ ID NO: 2764 - DNA, 110 bp, Artificial Sequence
  scaffold variant
ctactggcgcttttatctcattactttgagagccatcaccagcgactatgtcgtatgggtaaagcgcttatttatcggagagaaatgccgataaataagaagcatcaaag

SEQ ID NO: 2765 - DNA, 108 bp, Artificial Sequence
  scaffold variant
tactggcgcttttatctcattactttgagagccatcaccagcgactatgtcgtatgggtaaagcgcttattttcggagagaaatctcgataaataagaagcatcaaag

SEQ ID NO: 2766 - DNA, 108 bp, Artificial Sequence; identical to SEQ ID NO: 561
  scaffold variant

SEQ ID NO: 2767 - DNA, 109 bp, Artificial Sequence; identical to SEQ ID NO: 1228
  scaffold variant

SEQ ID NO: 2768 - DNA, 109 bp, Artificial Sequence; identical to SEQ ID NO: 957
  scaffold variant

SEQ ID NO: 2769 - DNA, 107 bp, Artificial Sequence; identical to SEQ ID NO: 960
  scaffold variant

SEQ ID NO: 2770 - DNA, 108 bp, Artificial Sequence
  scaffold variant
tactggcgcttttatctcattactttgagagccatcaccagcgactatgtcgtatgggtaaagcgcttatttacggagagaaatcacgataaataagaagcatcaaag

SEQ ID NO: 2771 - DNA, 107 bp, Artificial Sequence; identical to SEQ ID NO: 1136
  scaffold variant

SEQ ID NO: 2772 - DNA, 109 bp, Artificial Sequence; identical to SEQ ID NO: 785
  scaffold variant

SEQ ID NO: 2773 - DNA, 108 bp, Artificial Sequence; identical to SEQ ID NO: 1473
  scaffold variant

SEQ ID NO: 2774 - DNA, 106 bp, Artificial Sequence
  scaffold variant
tactggcgcttttatctcattactttgagagccatcaccagcgactatgtcgtatgggtaaagcgatatttatcgagagaaatccgataaataagaagcatcaaag

SEQ ID NO: 2775 - DNA, 107 bp, Artificial Sequence; identical to SEQ ID NO: 1307
  scaffold variant

SEQ ID NO: 2776 - DNA, 108 bp, Artificial Sequence
  scaffold variant
tactggcgcttttatctcattactttgagagccatcaccagcgactatgtcgtatgggtaaagcgcttatttatccagagaaatccgataaataagaagcatcaaagc

SEQ ID NO: 2777 - DNA, 109 bp, Artificial Sequence; identical to SEQ ID NO: 1831
  scaffold variant

SEQ ID NO: 2778 - DNA, 107 bp, Artificial Sequence; identical to SEQ ID NO: 1263
  scaffold variant

SEQ ID NO: 2779 - DNA, 109 bp, Artificial Sequence; identical to SEQ ID NO: 785
  scaffold variant

SEQ ID NO: 2780 - DNA, 110 bp, Artificial Sequence
  scaffold variant
tactggcgcttttatactcattactttgagagccatcaccagcgactatgtcgtatgggtaaagcgcttattctatcggagagaaatccgataaataagaagcatcaaag

SEQ ID NO: 2781 - DNA, 108 bp, Artificial Sequence
  scaffold variant
actggcgcttttatctcattactttgagagccatcaccagcgactatgtcgtatgggtaaagcgcttatttatcggagagtaaatccgataaataagaagcatcaaag

SEQ ID NO: 2782 - DNA, 110 bp, Artificial Sequence
  scaffold variant
taactggcgcttttatctcattactttgagagccatcaccagcgactatgtcgtatgggtaaagcgcttatttatcggcagagaaatccgataaataagaagcatcaaag

SEQ ID NO: 2783 - DNA, 109 bp, Artificial Sequence; identical to SEQ ID NO: 785
  scaffold variant

SEQ ID NO: 2784 - DNA, 107 bp, Artificial Sequence
  scaffold variant
ctggcgcttttatctcattactttgagagccatcaccagcgactatgtcgtatgggtaaagcgcttatttatcggagagtaaatccgataaataagaagcatcaaag

SEQ ID NO: 2785 - DNA, 107 bp, Artificial Sequence; identical to SEQ ID NO: 1723
  scaffold variant

SEQ ID NO: 2786 - DNA, 110 bp, Artificial Sequence
  scaffold variant
tactggcgcttttatctcgattactttgagagccatcaccagcgactatgtcgtatgggtaaagcgcttatttatcggagagaaatccgcataaataagaagcatcaaag

SEQ ID NO: 2787 - DNA, 105 bp, Artificial Sequence; identical to SEQ ID NO: 834
  scaffold variant

SEQ ID NO: 2788 - DNA, 106 bp, Artificial Sequence; identical to SEQ ID NO: 534
  scaffold variant

SEQ ID NO: 2789 - DNA, 107 bp, Artificial Sequence
  scaffold variant
tactggcgcttttatctcattactttgagagccatcaccagcgactatgtcgtatgggtaaagcgcttatttatcgttagaaatccgataaataagaagcatcaaag

SEQ ID NO: 2790 - DNA, 108 bp, Artificial Sequence
  scaffold variant
tactggcgcttttatctctattactttgagagccatcaccagcgactatgtcgtatgggtaaagcgcttatttatcggagagaaaacgataaataagaagcatcaaag

SEQ ID NO: 2791 - DNA, 109 bp, Artificial Sequence; identical to SEQ ID NO: 785
  scaffold variant

SEQ ID NO: 2792 - DNA, 107 bp, Artificial Sequence; identical to SEQ ID NO: 2443
  scaffold variant

SEQ ID NO: 2793 - DNA, 110 bp, Artificial Sequence
  scaffold variant
tactggcgcttttatctcattactttgagagccatcaccagcgactatgtcgtatgggtaaagcgcttatttatccggagagagaatccgataaataagaagcatcaaag

SEQ ID NO: 2794 - DNA, 107 bp, Artificial Sequence; identical to SEQ ID NO: 810
  scaffold variant

SEQ ID NO: 2795 - DNA, 107 bp, Artificial Sequence; identical to SEQ ID NO: 2443
  scaffold variant

SEQ ID NO: 2796 - DNA, 109 bp, Artificial Sequence; identical to SEQ ID NO: 2436
  scaffold variant

SEQ ID NO: 2797 - DNA, 107 bp, Artificial Sequence; identical to SEQ ID NO: 1263
  scaffold variant

SEQ ID NO: 2798 - DNA, 109 bp, Artificial Sequence; identical to SEQ ID NO: 1164
  scaffold variant

SEQ ID NO: 2799 - DNA, 109 bp, Artificial Sequence; identical to SEQ ID NO: 1025
  scaffold variant

SEQ ID NO: 2800 - DNA, 109 bp, Artificial Sequence; identical to SEQ ID NO: 785
  scaffold variant

SEQ ID NO: 2801 - DNA, 106 bp, Artificial Sequence
  scaffold variant
tactggcgcttttatctcattactttgagagccatcaccagcgactatgtcgtatgggtaaagcgcttatttacggagagaaatccataaataagaagcatcaaag

SEQ ID NO: 2802 - DNA, 107 bp, Artificial Sequence
  scaffold variant
tactggcgcttttatctctattactttgagagccatcaccagcgactatgtcgtatgggtaaagcgcttatttatcggggaaatccgataaataagaagcatcaaag

SEQ ID NO: 2803 - DNA, 107 bp, Artificial Sequence
  scaffold variant
tactggcgcttttatctcattactttgagagccataaccagcgactatgtcgtatgggtaaagcgcttatttatcgagagaaatccgataaataagaagcatcaaag

SEQ ID NO: 2804 - DNA, 109 bp, Artificial Sequence; identical to SEQ ID NO: 986
  scaffold variant

SEQ ID NO: 2805 - DNA, 107 bp, Artificial Sequence; identical to SEQ ID NO: 1081
  scaffold variant

SEQ ID NO: 2806 - DNA, 107 bp, Artificial Sequence
  scaffold variant
tacggcgcttttatctcattactttgagagccatcaccagcgactatgtcgtatgggtaaagctcttatttatcggagagaaatccgataaataagaagcatcaaag

SEQ ID NO: 2807 - DNA, 108 bp, Artificial Sequence; identical to SEQ ID NO: 655
  scaffold variant

SEQ ID NO: 2808 - DNA, 107 bp, Artificial Sequence; identical to SEQ ID NO: 1331
  scaffold variant

SEQ ID NO: 2809 - DNA, 106 bp, Artificial Sequence; identical to SEQ ID NO: 504
  scaffold variant

SEQ ID NO: 2810 - DNA, 107 bp, Artificial Sequence; identical to SEQ ID NO: 1752
  scaffold variant

SEQ ID NO: 2811 - DNA, 108 bp, Artificial Sequence; identical to SEQ ID NO: 419
  scaffold variant

SEQ ID NO: 2812 - DNA, 107 bp, Artificial Sequence; identical to SEQ ID NO: 960
  scaffold variant

SEQ ID NO: 2813 - DNA, 109 bp, Artificial Sequence; identical to SEQ ID NO: 1166
  scaffold variant

SEQ ID NO: 2814 - DNA, 106 bp, Artificial Sequence
  scaffold variant
tactggcgcttttatctcattactttgagagccatcaccagcgactatgtcgtatgggtaaagcgcttatttatggagagaaatccataaataagaagcatcaaag

SEQ ID NO: 2815 - DNA, 109 bp, Artificial Sequence
  scaffold variant
tactggcgcttttatcctcattactttgagagccatcaccagcgactatgtcgtatgggtaaagcgcttatttgtcggagagaaatccgataaataagaagcatcaaag

SEQ ID NO: 2816 - DNA, 109 bp, Artificial Sequence; identical to SEQ ID NO: 1222
  scaffold variant

SEQ ID NO: 2817 - DNA, 107 bp, Artificial Sequence; identical to SEQ ID NO: 1017
  scaffold variant

SEQ ID NO: 2818 - DNA, 109 bp, Artificial Sequence; identical to SEQ ID NO: 955
  scaffold variant

SEQ ID NO: 2819 - DNA, 109 bp, Artificial Sequence; identical to SEQ ID NO: 785
  scaffold variant

SEQ ID NO: 2820 - DNA, 107 bp, Artificial Sequence; identical to SEQ ID NO: 1789
  scaffold variant

SEQ ID NO: 2821 - DNA, 108 bp, Artificial Sequence
  scaffold variant
ctactggcgcttttatctcattactttgagagccatcaccagcgactatgtcgtatgggtaaagcgcttatttatcgtgagaaatccgataaataagaagcatcaaag

SEQ ID NO: 2822 - DNA, 106 bp, Artificial Sequence; identical to SEQ ID NO: 1979
  scaffold variant

SEQ ID NO: 2823 - DNA, 109 bp, Artificial Sequence
  scaffold variant
tactggcgcttttatcttcattactttgagagccatcaccagcgactatgtcgtatgggtaaagcgcttatttgtcggagagaaatccgataaataagaagcatcaaag

SEQ ID NO: 2824 - DNA, 107 bp, Artificial Sequence; identical to SEQ ID NO: 960
  scaffold variant

SEQ ID NO: 2825 - DNA, 106 bp, Artificial Sequence
  scaffold variant
tactggcgcttttatctcattactttgagagccatcaccagcgactatgtcgtatgggtaaagcggtatttatcggagataatccgataaataagaagcatcaaag

SEQ ID NO: 2826 - DNA, 108 bp, Artificial Sequence
  scaffold variant
tactggcgcttttatctcattactttgagagccatcaccagcgactatgtcgtatgggtaaagcgcttatttatccagagaaatccgataaataagaaagcatcaaag

SEQ ID NO: 2827 - DNA, 107 bp, Artificial Sequence
  scaffold variant
tactggcgcttttatctcattactttgagagccatcaccagcgactatgtcgtatgggtaaagcgcttatttatagagagaaatccgataaataagaagcatcaaag

SEQ ID NO: 2828 - DNA, 109 bp, Artificial Sequence; identical to SEQ ID NO: 1164
  scaffold variant

SEQ ID NO: 2829 - DNA, 109 bp, Artificial Sequence; identical to SEQ ID NO: 1228
  scaffold variant

SEQ ID NO: 2830 - DNA, 107 bp, Artificial Sequence; identical to SEQ ID NO: 878
  scaffold variant

SEQ ID NO: 2831 - DNA, 107 bp, Artificial Sequence; identical to SEQ ID NO: 1307
  scaffold variant

SEQ ID NO: 2832 - DNA, 109 bp, Artificial Sequence; identical to SEQ ID NO: 563
  scaffold variant

SEQ ID NO: 2833 - DNA, 106 bp, Artificial Sequence
  scaffold variant
tacggcgcttttatctcattactttgagagccatcaccagcgactatgtcgtatgggtaaagcgcttatttatcggagagaaatccgatagtaagaagcatcaaag

SEQ ID NO: 2834 - DNA, 107 bp, Artificial Sequence; identical to SEQ ID NO: 878
  scaffold variant

SEQ ID NO: 2835 - DNA, 109 bp, Artificial Sequence; identical to SEQ ID NO: 1222
  scaffold variant

SEQ ID NO: 2836 - DNA, 107 bp, Artificial Sequence; identical to SEQ ID NO: 1307
  scaffold variant

SEQ ID NO: 2837 - DNA, 109 bp, Artificial Sequence; identical to SEQ ID NO: 1093
  scaffold variant

SEQ ID NO: 2838 - DNA, 107 bp, Artificial Sequence
  scaffold variant
tctgtcgcttttatctcattactttgagagccatcaccagcgactatgtcgtatgggtaaagcgcttatttatcggagagaaatccgataaataagaagcatcaaag

SEQ ID NO: 2839 - DNA, 107 bp, Artificial Sequence; identical to SEQ ID NO: 1081
  scaffold variant

SEQ ID NO: 2840 - DNA, 108 bp, Artificial Sequence
  scaffold variant
tactggcgcttttatctcattactttgagagccatcaccagcgactatgtcgtatgggtaaagcgcttatttatgcggagagtatccgataaataagaagcatcaaag

SEQ ID NO: 2841 - DNA, 106 bp, Artificial Sequence; identical to SEQ ID NO: 446
  scaffold variant

SEQ ID NO: 2842 - DNA, 109 bp, Artificial Sequence; identical to SEQ ID NO: 1025
  scaffold variant

SEQ ID NO: 2843 - DNA, 109 bp, Artificial Sequence; identical to SEQ ID NO: 2617
  scaffold variant

SEQ ID NO: 2844 - DNA, 106 bp, Artificial Sequence; identical to SEQ ID NO: 1829
  scaffold variant

SEQ ID NO: 2845 - DNA, 108 bp, Artificial Sequence
  scaffold variant
tactggcgcttttatctacattactttgagagccatcaccagcgactatgtcgtatgggtaaagcgcttatttccggagagaaatccgataaataagaagcatcaaag

SEQ ID NO: 2846 - DNA, 109 bp, Artificial Sequence; identical to SEQ ID NO: 785
  scaffold variant

SEQ ID NO: 2847 - DNA, 106 bp, Artificial Sequence; identical to SEQ ID NO: 430
  scaffold variant

SEQ ID NO: 2848 - DNA, 109 bp, Artificial Sequence; identical to SEQ ID NO: 1228
  scaffold variant

SEQ ID NO: 2849 - DNA, 108 bp, Artificial Sequence
  scaffold variant
tactggcgcttttatctcattactttgagagccatcaccagcgactatgtcgtatgggtaaagcggtatttatcggcagagaaatccgataaataagaagcatcaaag

SEQ ID NO: 2850 - DNA, 107 bp, Artificial Sequence; identical to SEQ ID NO: 1307
  scaffold variant

SEQ ID NO: 2851 - DNA, 107 bp, Artificial Sequence
  scaffold variant
tactggcgcttttatctaattactttgagagccatcaccagcgactatgtcgtatgggtaaagcgcttatttatcaagagaaatccgataaataagaagcatcaaag

SEQ ID NO: 2852 - DNA, 107 bp, Artificial Sequence; identical to SEQ ID NO: 1017
  scaffold variant

SEQ ID NO: 2853 - DNA, 107 bp, Artificial Sequence; identical to SEQ ID NO: 1960
  scaffold variant

SEQ ID NO: 2854 - DNA, 109 bp, Artificial Sequence
  scaffold variant
tactggcgcttttatctaattactttgagagccatcaccagcgactatgtcgtatgggtaaagcgcttatttatcggagagaaatcccgataaataagaagcatcaaag

SEQ ID NO: 2855 - DNA, 107 bp, Artificial Sequence; identical to SEQ ID NO: 1752
  scaffold variant

SEQ ID NO: 2856 - DNA, 109 bp, Artificial Sequence; identical to SEQ ID NO: 785
  scaffold variant

SEQ ID NO: 2857 - DNA, 107 bp, Artificial Sequence; identical to SEQ ID NO: 878
  scaffold variant

SEQ ID NO: 2858 - DNA, 109 bp, Artificial Sequence; identical to SEQ ID NO: 882
  scaffold variant

SEQ ID NO: 2859 - DNA, 109 bp, Artificial Sequence; identical to SEQ ID NO: 957
  scaffold variant

SEQ ID NO: 2860 - DNA, 109 bp, Artificial Sequence; identical to SEQ ID NO: 785
  scaffold variant

SEQ ID NO: 2861 - DNA, 109 bp, Artificial Sequence; identical to SEQ ID NO: 1190
  scaffold variant

SEQ ID NO: 2862 - DNA, 109 bp, Artificial Sequence; identical to SEQ ID NO: 1228
  scaffold variant

SEQ ID NO: 2863 - DNA, 107 bp, Artificial Sequence; identical to SEQ ID NO: 1136
  scaffold variant

SEQ ID NO: 2864 - DNA, 107 bp, Artificial Sequence; identical to SEQ ID NO: 1081
  scaffold variant

SEQ ID NO: 2865 - DNA, 107 bp, Artificial Sequence; identical to SEQ ID NO: 1263
  scaffold variant

SEQ ID NO: 2866 - DNA, 107 bp, Artificial Sequence; identical to SEQ ID NO: 1081
  scaffold variant

SEQ ID NO: 2867 - DNA, 106 bp, Artificial Sequence; identical to SEQ ID NO: 1829
  scaffold variant

SEQ ID NO: 2868 - DNA, 110 bp, Artificial Sequence
  scaffold variant
tactggcgcttttatctcattactttgagagccatcaccagcgactatgtcgtatgggtaaagcgcttatttatccggagagaaatccgataaataagaagcatcaaagc

SEQ ID NO: 2869 - DNA, 106 bp, Artificial Sequence; identical to SEQ ID NO: 1829
  scaffold variant

SEQ ID NO: 2870 - DNA, 108 bp, Artificial Sequence; identical to SEQ ID NO: 655
  scaffold variant

SEQ ID NO: 2871 - DNA, 109 bp, Artificial Sequence; identical to SEQ ID NO: 992
  scaffold variant

SEQ ID NO: 2872 - DNA, 107 bp, Artificial Sequence; identical to SEQ ID NO: 1017
  scaffold variant

SEQ ID NO: 2873 - DNA, 106 bp, Artificial Sequence
  scaffold variant
cctggcgcttttattcattactttgagagccatcaccagcgactatgtcgtatgggtaaagcgcttatttatcggagagaaatccgataaataagaagcatcaaag

SEQ ID NO: 2874 - DNA, 108 bp, Artificial Sequence
  scaffold variant
tactggcgcttttatctcattactttgagagccatcaccagcgactatgtcgtatgggtaaagcgcttattctatcggagagaaatccataaataagaagcatcaaag

SEQ ID NO: 2875 - DNA, 107 bp, Artificial Sequence; identical to SEQ ID NO: 1035
  scaffold variant

SEQ ID NO: 2876 - DNA, 108 bp, Artificial Sequence
  scaffold variant
tactggcgcttttatctcattactttgagagccatcaccagcgactatgtcgtatgggtaaagcgcttatttatcgggagaaatccgataaataagaagcatcaaagc

SEQ ID NO: 2877 - DNA, 107 bp, Artificial Sequence; identical to SEQ ID NO: 1960
  scaffold variant

SEQ ID NO: 2878 - DNA, 107 bp, Artificial Sequence; identical to SEQ ID NO: 1035
  scaffold variant

SEQ ID NO: 2879 - DNA, 105 bp, Artificial Sequence; identical to SEQ ID NO: 473
  scaffold variant

SEQ ID NO: 2880 - DNA, 107 bp, Artificial Sequence; identical to SEQ ID NO: 1960
  scaffold variant

SEQ ID NO: 2881 - DNA, 109 bp, Artificial Sequence; identical to SEQ ID NO: 957
  scaffold variant

SEQ ID NO: 2882 - DNA, 108 bp, Artificial Sequence
  scaffold variant
tactggcgcttttatctcattactttgagagccatcaccagcgactatgtcgtatgggtaaagcgcttatttgcggagagaaatcgcgataaataagaagcatcaaag

SEQ ID NO: 2883 - DNA, 107 bp, Artificial Sequence
  scaffold variant
tacggcgcttttatctcattactttgagagccatcaccagcgactatgtcgtatgggtaaagcgcttatttatcggagagaaattcgataaataagaagcatcaaag

SEQ ID NO: 2884 - DNA, 110 bp, Artificial Sequence
  scaffold variant
tactggcgcttttatctcattactttgagagccatcaccagcgactatgtcgtatgggtaaagcgcttatttatcgggagagaaatccgataaataagaagcatcaaagc

SEQ ID NO: 2885 - DNA, 109 bp, Artificial Sequence; identical to SEQ ID NO: 957
  scaffold variant

SEQ ID NO: 2886 - DNA, 106 bp, Artificial Sequence; identical to SEQ ID NO: 1829
  scaffold variant

SEQ ID NO: 2887 - DNA, 110 bp, Artificial Sequence
  scaffold variant
tactggcgcttttatctcattactttgagagccatcaccagcgactatgtcgtatgggtaaagcgcttatttatccggagagaaaatccgataaataagaagcatcaaag

SEQ ID NO: 2888 - DNA, 109 bp, Artificial Sequence; identical to SEQ ID NO: 957
  scaffold variant

SEQ ID NO: 2889 - DNA, 108 bp, Artificial Sequence
  scaffold variant
tactggcgcttttattctcattactttgagagccatcaccagcgactatgtcgtatgggtaaagcgttatttatcggagagaaatccgataaataagaagcatcaaag

SEQ ID NO: 2890 - DNA, 107 bp, Artificial Sequence; identical to SEQ ID NO: 1889
  scaffold variant

SEQ ID NO: 2891 - DNA, 109 bp, Artificial Sequence; identical to SEQ ID NO: 1055
  scaffold variant

SEQ ID NO: 2892 - DNA, 107 bp, Artificial Sequence; identical to SEQ ID NO: 1307
  scaffold variant

SEQ ID NO: 2893 - DNA, 107 bp, Artificial Sequence; identical to SEQ ID NO: 1889
  scaffold variant

SEQ ID NO: 2894 - DNA, 107 bp, Artificial Sequence; identical to SEQ ID NO: 1035
  scaffold variant

SEQ ID NO: 2895 - DNA, 109 bp, Artificial Sequence; identical to SEQ ID NO: 1600
  scaffold variant

SEQ ID NO: 2896 - DNA, 108 bp, Artificial Sequence
  scaffold variant
tactggcgcttttatctcattactttgagagccatcaccagcgactatgtcgtatgggtaaagcgcttatttatcgggagagaaatccgataataagaagcatcaaag

SEQ ID NO: 2897 - DNA, 108 bp, Artificial Sequence
  scaffold variant
tactggcgcttttattctcattactttgagagccatcaccagcgactatgtcgtatgggtaaagcgcttatttatcggagagaaatccgatagtaagaagcatcaaag

SEQ ID NO: 2898 - DNA, 107 bp, Artificial Sequence; identical to SEQ ID NO: 1136
  scaffold variant

SEQ ID NO: 2899 - DNA, 107 bp, Artificial Sequence; identical to SEQ ID NO: 2443
  scaffold variant

SEQ ID NO: 2900 - DNA, 109 bp, Artificial Sequence; identical to SEQ ID NO: 1164
  scaffold variant

SEQ ID NO: 2901 - DNA, 107 bp, Artificial Sequence; identical to SEQ ID NO: 1142
  scaffold variant

SEQ ID NO: 2902 - DNA, 109 bp, Artificial Sequence; identical to SEQ ID NO: 785
  scaffold variant

SEQ ID NO: 2903 - DNA, 107 bp, Artificial Sequence; identical to SEQ ID NO: 1017
  scaffold variant

SEQ ID NO: 2904 - DNA, 109 bp, Artificial Sequence
  scaffold variant
tactggcgcttttatctaattactttgagagccatcaccagcgactatgtcgtatgggtaaagcgcttatttatcgggagagaaatccgataaataagaagcatcaaag

SEQ ID NO: 2905 - DNA, 110 bp, Artificial Sequence
  scaffold variant
tactggcgcttttatctcattactttgagagccatcaccagcgactatgtcgtattgggtaaagcgcttatttatacggagagaaatccgataaataagaagcatcaaag

SEQ ID NO: 2906 - DNA, 108 bp, Artificial Sequence
  scaffold variant
tactggcgcttttatctcattactttgagagccatcaccagcgactatgtcgtatgggtaaagcgcttatttattcggagagaaatccgatagtaagaagcatcaaag

SEQ ID NO: 2907 - DNA, 106 bp, Artificial Sequence; identical to SEQ ID NO: 529
  scaffold variant

SEQ ID NO: 2908 - DNA, 109 bp, Artificial Sequence
  scaffold variant
tactggcgcttttattctcattactttgagagccatcaccagcgactatgtcgtatgggtaaagcgcttatttatctgagagaaatccgataaataagaagcatcaaag

SEQ ID NO: 2909 - DNA, 109 bp, Artificial Sequence; identical to SEQ ID NO: 785
  scaffold variant

SEQ ID NO: 2910 - DNA, 107 bp, Artificial Sequence; identical to SEQ ID NO: 878
  scaffold variant

SEQ ID NO: 2911 - DNA, 110 bp, Artificial Sequence
  scaffold variant
tactggcgcttttatctcattactttgagagccatcaccagcgactatgtcgtatgggtaaagcgcttatttatacggagagaaatccgaataaataagaagcatcaaag

SEQ ID NO: 2912 - DNA, 110 bp, Artificial Sequence
  scaffold variant
tactggcgcttttatctcattactttgagagccatcaccagcgactatgtcgtatgggtaaagcgcttattttatcgggagagaaatccgataaataagaagcatcaaag

SEQ ID NO: 2913 - DNA, 107 bp, Artificial Sequence; identical to SEQ ID NO: 1035
  scaffold variant

SEQ ID NO: 2914 - DNA, 107 bp, Artificial Sequence; identical to SEQ ID NO: 1081
  scaffold variant

SEQ ID NO: 2915 - DNA, 107 bp, Artificial Sequence; identical to SEQ ID NO: 1960
  scaffold variant

SEQ ID NO: 2916 - DNA, 109 bp, Artificial Sequence; identical to SEQ ID NO: 1228
  scaffold variant

SEQ ID NO: 2917 - DNA, 107 bp, Artificial Sequence; identical to SEQ ID NO: 878
  scaffold variant

SEQ ID NO: 2918 - DNA, 108 bp, Artificial Sequence
  scaffold variant
tactggcgcttttatctcattactttgagagccatcaccagcgactatgtcgtatgggtaaagctttatttatcggagagaaatcgcgataaataagaagcatcaaag

SEQ ID NO: 2919 - DNA, 108 bp, Artificial Sequence
  scaffold variant
tactggcgcttttatctcattactttgagagccatcaccagcgactatgtcgtatgggtaaagcgcttatttactcggagagaaatcgataaataagaagcatcaaag

SEQ ID NO: 2920 - DNA, 107 bp, Artificial Sequence; identical to SEQ ID NO: 1017
  scaffold variant

SEQ ID NO: 2921 - DNA, 106 bp, Artificial Sequence; identical to SEQ ID NO: 835
  scaffold variant

SEQ ID NO: 2922 - DNA, 107 bp, Artificial Sequence; identical to SEQ ID NO: 1307
  scaffold variant

SEQ ID NO: 2923 - DNA, 109 bp, Artificial Sequence; identical to SEQ ID NO: 1222
  scaffold variant

SEQ ID NO: 2924 - DNA, 105 bp, Artificial Sequence; identical to SEQ ID NO: 424
  scaffold variant

SEQ ID NO: 2925 - DNA, 107 bp, Artificial Sequence; identical to SEQ ID NO: 1736
  scaffold variant

SEQ ID NO: 2926 - DNA, 109 bp, Artificial Sequence; identical to SEQ ID NO: 1164
  scaffold variant

SEQ ID NO: 2927 - DNA, 109 bp, Artificial Sequence; identical to SEQ ID NO: 1600
  scaffold variant

SEQ ID NO: 2928 - DNA, 110 bp, Artificial Sequence
  scaffold variant
tactggcgcttttatctcattactttgagagccatcaccagcgactatgtcgtatgggtaaagcgcttatttatacggagagaaatccgataaataagagagcatcaaag

SEQ ID NO: 2929 - DNA, 109 bp, Artificial Sequence
  scaffold variant
tactggcgcttttatctcattactttgagagccatcaacagcgactatgtcgtatgggtaaagcgcttatttatgcggagagaaatccgataaataagaagcatcaaag

SEQ ID NO: 2930 - DNA, 107 bp, Artificial Sequence
  scaffold variant
tactggcgcttttatctcattactttgagagccatcaccagcgactatgtcgtatgggtaaagcgcttatttatagggagaaatccgataaataagaagcatcaaag

SEQ ID NO: 2931 - DNA, 107 bp, Artificial Sequence
  scaffold variant
tactggcgcttttatcccattactttgagagccatcaccagcgactatgtcgtatgggtaaagcgcttatttatcgagagaaatccgataaataagaagcatcaaag

SEQ ID NO: 2932 - DNA, 108 bp, Artificial Sequence
  scaffold variant
tactggcgcttttatctcattactttgagagccatcaccagcgactatgtcgtatgggtaaagcgcttatttagtcggagagaaatccataaataagaagcatcaaag

SEQ ID NO: 2933 - DNA, 108 bp, Artificial Sequence
  scaffold variant
tactggcgcttttatctcattactttgagagccatcaccagcgactatgtcgtatgggtaaagcgcttatttgcggagagaaatcccgataaataagaagcatcaaag

SEQ ID NO: 2934 - DNA, 107 bp, Artificial Sequence; identical to SEQ ID NO: 1307
  scaffold variant

SEQ ID NO: 2935 - DNA, 106 bp, Artificial Sequence; identical to SEQ ID NO: 532
  scaffold variant

SEQ ID NO: 2936 - DNA, 107 bp, Artificial Sequence
  scaffold variant
tacggcgcttttatctcattactttgagagccatcaccagcgactatgtcgtatgggtaaagcgcttatttatcgaagagaaatccgataaataagaagcatcaaag

SEQ ID NO: 2937 - DNA, 107 bp, Artificial Sequence; identical to SEQ ID NO: 1960
  scaffold variant

SEQ ID NO: 2938 - DNA, 109 bp, Artificial Sequence; identical to SEQ ID NO: 563
  scaffold variant

SEQ ID NO: 2939 - DNA, 107 bp, Artificial Sequence; identical to SEQ ID NO: 1035
  scaffold variant

SEQ ID NO: 2940 - DNA, 109 bp, Artificial Sequence; identical to SEQ ID NO: 2298
  scaffold variant

SEQ ID NO: 2941 - DNA, 107 bp, Artificial Sequence; identical to SEQ ID NO: 1752
  scaffold variant

SEQ ID NO: 2942 - DNA, 107 bp, Artificial Sequence; identical to SEQ ID NO: 1723
  scaffold variant

SEQ ID NO: 2943 - DNA, 107 bp, Artificial Sequence; identical to SEQ ID NO: 1802
  scaffold variant

SEQ ID NO: 2944 - DNA, 107 bp, Artificial Sequence; identical to SEQ ID NO: 1307
  scaffold variant

SEQ ID NO: 2945 - DNA, 106 bp, Artificial Sequence; identical to SEQ ID NO: 430
  scaffold variant

SEQ ID NO: 2946 - DNA, 108 bp, Artificial Sequence
  scaffold variant
tactggcgcttttatctcattactttgagagccatcaccagcgactatgtcgtattgggtaaagcgcttatttattgagagaaatccgataaataagaagcatcaaag

SEQ ID NO: 2947 - DNA, 107 bp, Artificial Sequence; identical to SEQ ID NO: 1752
  scaffold variant

SEQ ID NO: 2948 - DNA, 107 bp, Artificial Sequence
  scaffold variant
cactggcgcttttatctcattactttgagagccatcaccagcgactatgtcgtatgggtaaagcgcttatttattgagagaaatccgataaataagaagcatcaaag

SEQ ID NO: 2949 - DNA, 107 bp, Artificial Sequence; identical to SEQ ID NO: 520
  scaffold variant

SEQ ID NO: 2950 - DNA, 109 bp, Artificial Sequence
  scaffold variant
tactggcgcttttatctaattactttgagagccatcaccagcgactatgtcgtatgggtaaagcgcttatttatcggagagaaatcgcgataaataagaagcatcaaag

SEQ ID NO: 2951 - DNA, 109 bp, Artificial Sequence; identical to SEQ ID NO: 785
  scaffold variant

SEQ ID NO: 2952 - DNA, 106 bp, Artificial Sequence; identical to SEQ ID NO: 474
  scaffold variant

SEQ ID NO: 2953 - DNA, 108 bp, Artificial Sequence
  scaffold variant
tactggcgcttttatctcattactttgagagccatcaccagcgactatgtcgtatgggtaaagcgcttatttatcgagagaaatccgcataaataagaagcatcaaag

SEQ ID NO: 2954 - DNA, 109 bp, Artificial Sequence; identical to SEQ ID NO: 785
  scaffold variant

SEQ ID NO: 2955 - DNA, 107 bp, Artificial Sequence; identical to SEQ ID NO: 1081
  scaffold variant

SEQ ID NO: 2956 - DNA, 109 bp, Artificial Sequence; identical to SEQ ID NO: 785
  scaffold variant

SEQ ID NO: 2957 - DNA, 108 bp, Artificial Sequence
  scaffold variant
tactggcgcttttatctcattactttgagagccatcaccagcgactatgtcgtatgggtaaagcgcttatttaatcggagagaaatccataaataagaagcatcaaag

SEQ ID NO: 2958 - DNA, 107 bp, Artificial Sequence; identical to SEQ ID NO: 1736
  scaffold variant

SEQ ID NO: 2959 - DNA, 109 bp, Artificial Sequence; identical to SEQ ID NO: 957
  scaffold variant

SEQ ID NO: 2960 - DNA, 109 bp, Artificial Sequence; identical to SEQ ID NO: 986
  scaffold variant

SEQ ID NO: 2961 - DNA, 107 bp, Artificial Sequence
  scaffold variant
tactggcgcttttatctcattactttgagagccatcaccagcgactatgtcgtatgggtaaagcgcttatttatcgggaggaatccgataaataagaagcatcaaag

SEQ ID NO: 2962 - DNA, 109 bp, Artificial Sequence; identical to SEQ ID NO: 1055
  scaffold variant

SEQ ID NO: 2963 - DNA, 107 bp, Artificial Sequence
  scaffold variant
cctggcgcttttatcccattactttgagagccatcaccagcgactatgtcgtatgggtaaagcgcttatttatcggagagaaatccgataaataagaagcatcaaag

SEQ ID NO: 2964 - DNA, 109 bp, Artificial Sequence; identical to SEQ ID NO: 986
  scaffold variant

SEQ ID NO: 2965 - DNA, 107 bp, Artificial Sequence; identical to SEQ ID NO: 2443
  scaffold variant

SEQ ID NO: 2966 - DNA, 109 bp, Artificial Sequence; identical to SEQ ID NO: 1228
  scaffold variant

SEQ ID NO: 2967 - DNA, 107 bp, Artificial Sequence; identical to SEQ ID NO: 1736
  scaffold variant

SEQ ID NO: 2968 - DNA, 106 bp, Artificial Sequence
  scaffold variant
tggcgcttttatctcattactttgagagccatcaccagcgactatgtcgtatgggtaaagcgcttatttatctggagagaaatccgataaataagaagcatcaaag

SEQ ID NO: 2969 - DNA, 109 bp, Artificial Sequence; identical to SEQ ID NO: 2617
  scaffold variant

SEQ ID NO: 2970 - DNA, 106 bp, Artificial Sequence; identical to SEQ ID NO: 448
  scaffold variant

SEQ ID NO: 2971 - DNA, 107 bp, Artificial Sequence; identical to SEQ ID NO: 1723
  scaffold variant

SEQ ID NO: 2972 - DNA, 106 bp, Artificial Sequence; identical to SEQ ID NO: 1829
  scaffold variant

SEQ ID NO: 2973 - DNA, 109 bp, Artificial Sequence; identical to SEQ ID NO: 563
  scaffold variant

SEQ ID NO: 2974 - DNA, 107 bp, Artificial Sequence; identical to SEQ ID NO: 1960
  scaffold variant

SEQ ID NO: 2975 - DNA, 109 bp, Artificial Sequence; identical to SEQ ID NO: 785
  scaffold variant

SEQ ID NO: 2976 - DNA, 107 bp, Artificial Sequence; identical to SEQ ID NO: 2608
  scaffold variant

SEQ ID NO: 2977 - DNA, 107 bp, Artificial Sequence; identical to SEQ ID NO: 1307
  scaffold variant

SEQ ID NO: 2978 - DNA, 107 bp, Artificial Sequence; identical to SEQ ID NO: 1263
  scaffold variant

SEQ ID NO: 2979 - DNA, 108 bp, Artificial Sequence
  scaffold variant
tactggcgcttttatctcattactttgagagccatcaccagcgactatgtcgtatgggtaaagcgcttatttattgagagaaatcccgataaataagaagcatcaaag

SEQ ID NO: 2980 - DNA, 106 bp, Artificial Sequence; identical to SEQ ID NO: 907
  scaffold variant

SEQ ID NO: 2981 - DNA, 107 bp, Artificial Sequence; identical to SEQ ID NO: 960
  scaffold variant

SEQ ID NO: 2982 - DNA, 109 bp, Artificial Sequence; identical to SEQ ID NO: 1025
  scaffold variant

SEQ ID NO: 2983 - DNA, 109 bp, Artificial Sequence; identical to SEQ ID NO: 1228
  scaffold variant

SEQ ID NO: 2984 - DNA, 107 bp, Artificial Sequence; identical to SEQ ID NO: 1307
  scaffold variant

SEQ ID NO: 2985 - DNA, 107 bp, Artificial Sequence; identical to SEQ ID NO: 1307
  scaffold variant

SEQ ID NO: 2986 - DNA, 107 bp, Artificial Sequence
  scaffold variant
cctggcgcttttatctcattactttgagagccatcaccagcgactatgtcgtatgggtaaagcacttatttatcggagagaaatccgataaataagaagcatcaaag

SEQ ID NO: 2987 - DNA, 107 bp, Artificial Sequence; identical to SEQ ID NO: 1723
  scaffold variant

SEQ ID NO: 2988 - DNA, 107 bp, Artificial Sequence; identical to SEQ ID NO: 878
  scaffold variant

SEQ ID NO: 2989 - DNA, 109 bp, Artificial Sequence; identical to SEQ ID NO: 785
  scaffold variant

SEQ ID NO: 2990 - DNA, 107 bp, Artificial Sequence; identical to SEQ ID NO: 1017
  scaffold variant

SEQ ID NO: 2991 - DNA, 106 bp, Artificial Sequence; identical to SEQ ID NO: 529
  scaffold variant

SEQ ID NO: 2992 - DNA, 109 bp, Artificial Sequence; identical to SEQ ID NO: 1062
  scaffold variant

SEQ ID NO: 2993 - DNA, 107 bp, Artificial Sequence; identical to SEQ ID NO: 1889
  scaffold variant

SEQ ID NO: 2994 - DNA, 107 bp, Artificial Sequence; identical to SEQ ID NO: 1017
  scaffold variant

SEQ ID NO: 2995 - DNA, 109 bp, Artificial Sequence; identical to SEQ ID NO: 992
  scaffold variant

SEQ ID NO: 2996 - DNA, 107 bp, Artificial Sequence; identical to SEQ ID NO: 1723
  scaffold variant

SEQ ID NO: 2997 - DNA, 107 bp, Artificial Sequence; identical to SEQ ID NO: 1960
  scaffold variant

SEQ ID NO: 2998 - DNA, 107 bp, Artificial Sequence; identical to SEQ ID NO: 878
  scaffold variant

SEQ ID NO: 2999 - DNA, 107 bp, Artificial Sequence
  scaffold variant
tactggcgcttttatctcattactttgagagccatcaccagcgactatgtcgtattggtaaagcgcttatttatcgagagaaatccgataaataagaagcatcaaag

SEQ ID NO: 3000 - DNA, 107 bp, Artificial Sequence; identical to SEQ ID NO: 1081
  scaffold variant

SEQ ID NO: 3001 - DNA, 107 bp, Artificial Sequence; identical to SEQ ID NO: 1017
  scaffold variant

SEQ ID NO: 3002 - DNA, 108 bp, Artificial Sequence
  scaffold variant
tactggcgcttttatctcattactttgagagccatcaccagcgactatgtcgtatgggtaaagcgcttattttatcggagagaaatccataaataagaagcatcaaag

SEQ ID NO: 3003 - DNA, 106 bp, Artificial Sequence
  scaffold variant
tactggcgcttttatctcattactttgagagccatcaccagcgactatgtcgtatgggtaaagcggtatttatcggaagaaatccgataaataagaagcatcaaag

SEQ ID NO: 3004 - DNA, 107 bp, Artificial Sequence; identical to SEQ ID NO: 1017
  scaffold variant

SEQ ID NO: 3005 - DNA, 108 bp, Artificial Sequence
  scaffold variant
tactggcgcttttatctcattactttgagagccatcaccagcgactatgtcgtatgggtaaagcgcttatttaatcggagagaaatcgataaataagaagcatcaaag

SEQ ID NO: 3006 - DNA, 107 bp, Artificial Sequence; identical to SEQ ID NO: 1017
  scaffold variant

SEQ ID NO: 3007 - DNA, 109 bp, Artificial Sequence; identical to SEQ ID NO: 785
  scaffold variant

SEQ ID NO: 3008 - DNA, 107 bp, Artificial Sequence; identical to SEQ ID NO: 1263
  scaffold variant

SEQ ID NO: 3009 - DNA, 109 bp, Artificial Sequence; identical to SEQ ID NO: 1025
  scaffold variant

SEQ ID NO: 3010 - DNA, 109 bp, Artificial Sequence; identical to SEQ ID NO: 785
  scaffold variant

SEQ ID NO: 3011 - DNA, 110 bp, Artificial Sequence
  scaffold variant
tactggcgcttttatctcattactttgagagccatcaccagcgactatgtcgtatgggtaaagcgcttatttattcggagagaaatgccgataaataagaagcatcaaag

SEQ ID NO: 3012 - DNA, 109 bp, Artificial Sequence; identical to SEQ ID NO: 1164
  scaffold variant

SEQ ID NO: 3013 - DNA, 107 bp, Artificial Sequence; identical to SEQ ID NO: 1960
  scaffold variant

SEQ ID NO: 3014 - DNA, 109 bp, Artificial Sequence; identical to SEQ ID NO: 1025
  scaffold variant

SEQ ID NO: 3015 - DNA, 107 bp, Artificial Sequence; identical to SEQ ID NO: 2458
  scaffold variant

SEQ ID NO: 3016 - DNA, 109 bp, Artificial Sequence
  scaffold variant
tactggcgcttttatctcattactttgagagccatcaccagcgactatgtcgtatgggtaaagcgcttatttatccggagggaaatccgataaataagaagcatcaaag

SEQ ID NO: 3017 - DNA, 107 bp, Artificial Sequence; identical to SEQ ID NO: 2458
  scaffold variant

SEQ ID NO: 3018 - DNA, 107 bp, Artificial Sequence
  scaffold variant
cctggcgcttttatctaattactttgagagccatcaccagcgactatgtcgtatgggtaaagcgcttatttatcggagagaaatccgataaataagaagcatcaaag

SEQ ID NO: 3019 - DNA, 108 bp, Artificial Sequence
  scaffold variant
tactggcgcttttatctcattactttgagagccatcaccagcgactatgtcgtatgggtaaagcgcttattctatcggagagaaatcgataaataagaagcatcaaag

SEQ ID NO: 3020 - DNA, 106 bp, Artificial Sequence; identical to SEQ ID NO: 504
  scaffold variant

SEQ ID NO: 3021 - DNA, 107 bp, Artificial Sequence; identical to SEQ ID NO: 1752
  scaffold variant

SEQ ID NO: 3022 - DNA, 106 bp, Artificial Sequence; identical to SEQ ID NO: 430
  scaffold variant

SEQ ID NO: 3023 - DNA, 107 bp, Artificial Sequence; identical to SEQ ID NO: 1081
  scaffold variant

SEQ ID NO: 3024 - DNA, 107 bp, Artificial Sequence; identical to SEQ ID NO: 1017
  scaffold variant

SEQ ID NO: 3025 - DNA, 107 bp, Artificial Sequence; identical to SEQ ID NO: 1723
  scaffold variant

SEQ ID NO: 3026 - DNA, 109 bp, Artificial Sequence; identical to SEQ ID NO: 1049
  scaffold variant

SEQ ID NO: 3027 - DNA, 109 bp, Artificial Sequence; identical to SEQ ID NO: 1190
  scaffold variant

SEQ ID NO: 3028 - DNA, 107 bp, Artificial Sequence; identical to SEQ ID NO: 1307
  scaffold variant

SEQ ID NO: 3029 - DNA, 107 bp, Artificial Sequence; identical to SEQ ID NO: 1889
  scaffold variant

SEQ ID NO: 3030 - DNA, 109 bp, Artificial Sequence; identical to SEQ ID NO: 1190
  scaffold variant

SEQ ID NO: 3031 - DNA, 107 bp, Artificial Sequence; identical to SEQ ID NO: 960
  scaffold variant

SEQ ID NO: 3032 - DNA, 107 bp, Artificial Sequence; identical to SEQ ID NO: 1382
  scaffold variant

SEQ ID NO: 3033 - DNA, 107 bp, Artificial Sequence; identical to SEQ ID NO: 1142
  scaffold variant

SEQ ID NO: 3034 - DNA, 108 bp, Artificial Sequence
  scaffold variant
tactggcgcttttatctcattactttgagagccatcaccagcgactatgtcgtatgggtaaagcgcttattttatcggagaggatccgataaataagaagcatcaaag

SEQ ID NO: 3035 - DNA, 106 bp, Artificial Sequence; identical to SEQ ID NO: 446
  scaffold variant

SEQ ID NO: 3036 - DNA, 107 bp, Artificial Sequence; identical to SEQ ID NO: 1263
  scaffold variant

SEQ ID NO: 3037 - DNA, 107 bp, Artificial Sequence; identical to SEQ ID NO: 2458
  scaffold variant

SEQ ID NO: 3038 - DNA, 107 bp, Artificial Sequence
  scaffold variant
tactggcgcttttatttcattactttgagagccatcaccagcgactatgtcgtatgggtaaagcgcttatttatccagagaaatccgataaataagaagcatcaaag

SEQ ID NO: 3039 - DNA, 106 bp, Artificial Sequence; identical to SEQ ID NO: 1829
  scaffold variant

SEQ ID NO: 3040 - DNA, 106 bp, Artificial Sequence; identical to SEQ ID NO: 539
  scaffold variant

SEQ ID NO: 3041 - DNA, 106 bp, Artificial Sequence; identical to SEQ ID NO: 1979
  scaffold variant

SEQ ID NO: 3042 - DNA, 109 bp, Artificial Sequence; identical to SEQ ID NO: 1228
  scaffold variant

SEQ ID NO: 3043 - DNA, 109 bp, Artificial Sequence; identical to SEQ ID NO: 1600
  scaffold variant

SEQ ID NO: 3044 - DNA, 110 bp, Artificial Sequence
  scaffold variant
tactggcgcttttatctcattactttgagagccatcaccagcgactatgtcgtatgggtaaagcgcttatttatacggagagaaatccgataaataagaagcatcaaagc

SEQ ID NO: 3045 - DNA, 109 bp, Artificial Sequence
  scaffold variant
tactggcgcttttatctcattactttgagagccatcaccagcgactatgtagtatgggtaaagcgcttatttatgcggagagaaatccgataaataagaagcatcaaag

SEQ ID NO: 3046 - DNA, 107 bp, Artificial Sequence; identical to SEQ ID NO: 1723
  scaffold variant

SEQ ID NO: 3047 - DNA, 107 bp, Artificial Sequence; identical to SEQ ID NO: 810
  scaffold variant

SEQ ID NO: 3048 - DNA, 107 bp, Artificial Sequence; identical to SEQ ID NO: 1307
  scaffold variant

SEQ ID NO: 3049 - DNA, 109 bp, Artificial Sequence; identical to SEQ ID NO: 1190
  scaffold variant

SEQ ID NO: 3050 - DNA, 106 bp, Artificial Sequence; identical to SEQ ID NO: 2395
  scaffold variant

SEQ ID NO: 3051 - DNA, 107 bp, Artificial Sequence; identical to SEQ ID NO: 1035
  scaffold variant

SEQ ID NO: 3052 - DNA, 107 bp, Artificial Sequence; identical to SEQ ID NO: 1889
  scaffold variant

SEQ ID NO: 3053 - DNA, 109 bp, Artificial Sequence; identical to SEQ ID NO: 1025
  scaffold variant

SEQ ID NO: 3054 - DNA, 108 bp, Artificial Sequence; identical to SEQ ID NO: 487
  scaffold variant

SEQ ID NO: 3055 - DNA, 107 bp, Artificial Sequence; identical to SEQ ID NO: 1736
  scaffold variant

SEQ ID NO: 3056 - DNA, 109 bp, Artificial Sequence; identical to SEQ ID NO: 1025
  scaffold variant

SEQ ID NO: 3057 - DNA, 109 bp, Artificial Sequence; identical to SEQ ID NO: 785
  scaffold variant

SEQ ID NO: 3058 - DNA, 106 bp, Artificial Sequence; identical to SEQ ID NO: 430
  scaffold variant

SEQ ID NO: 3059 - DNA, 108 bp, Artificial Sequence
  scaffold variant
tactggcgcttttatctcattactttgagagccatcaccagcgactatgtcgtatgggtaaagcgcttattttatcggagagaatccgataaataagaagcatcaaag

SEQ ID NO: 3060 - DNA, 108 bp, Artificial Sequence
  scaffold variant
tactggcgcttttatctcattactttgagagccatcaccagcgactatgtcgtatgggtaaagcgcttatttatctagagaaatccgataaataagaagcatcaaagc

SEQ ID NO: 3061 - DNA, 106 bp, Artificial Sequence; identical to SEQ ID NO: 416
  scaffold variant

SEQ ID NO: 3062 - DNA, 109 bp, Artificial Sequence
  scaffold variant
tactggcgcttttatctcattactttgagagccatcaccagcgactatgtcgtatgggtaaagcgcttatttattaggagagaaatccgataaataagaagcatcaaag

SEQ ID NO: 3063 - DNA, 107 bp, Artificial Sequence
  scaffold variant
tactggcgcttttatctaattactttgagagccatcaccagcgactatgtcgtatgggtaaagcgcttatttatctagagaaatccgataaataagaagcatcaaag

SEQ ID NO: 3064 - DNA, 109 bp, Artificial Sequence; identical to SEQ ID NO: 1190
  scaffold variant

SEQ ID NO: 3065 - DNA, 109 bp, Artificial Sequence; identical to SEQ ID NO: 1600
  scaffold variant

SEQ ID NO: 3066 - DNA, 107 bp, Artificial Sequence; identical to SEQ ID NO: 1035
  scaffold variant

SEQ ID NO: 3067 - DNA, 108 bp, Artificial Sequence; identical to SEQ ID NO: 580
  scaffold variant

SEQ ID NO: 3068 - DNA, 109 bp, Artificial Sequence; identical to SEQ ID NO: 957
  scaffold variant

SEQ ID NO: 3069 - DNA, 109 bp, Artificial Sequence; identical to SEQ ID NO: 563
  scaffold variant

SEQ ID NO: 3070 - DNA, 107 bp, Artificial Sequence; identical to SEQ ID NO: 1017
  scaffold variant

SEQ ID NO: 3071 - DNA, 107 bp, Artificial Sequence; identical to SEQ ID NO: 1802
  scaffold variant

SEQ ID NO: 3072 - DNA, 107 bp, Artificial Sequence; identical to SEQ ID NO: 960
  scaffold variant

SEQ ID NO: 3073 - DNA, 108 bp, Artificial Sequence; identical to SEQ ID NO: 449
  scaffold variant

SEQ ID NO: 3074 - DNA, 107 bp, Artificial Sequence; identical to SEQ ID NO: 2458
  scaffold variant

SEQ ID NO: 3075 - DNA, 109 bp, Artificial Sequence; identical to SEQ ID NO: 1055
  scaffold variant

SEQ ID NO: 3076 - DNA, 108 bp, Artificial Sequence; identical to SEQ ID NO: 1473
  scaffold variant

SEQ ID NO: 3077 - DNA, 109 bp, Artificial Sequence; identical to SEQ ID NO: 1190
  scaffold variant

SEQ ID NO: 3078 - DNA, 106 bp, Artificial Sequence
  scaffold variant
tactggcgcttttatctcattactttgagagccatcaccagcgactatgtcgtatgggtaaagctttatttatcgggagaaatccgataaataagaagcatcaaag

SEQ ID NO: 3079 - DNA, 109 bp, Artificial Sequence; identical to SEQ ID NO: 1055
  scaffold variant

SEQ ID NO: 3080 - DNA, 107 bp, Artificial Sequence; identical to SEQ ID NO: 1263
  scaffold variant

SEQ ID NO: 3081 - DNA, 107 bp, Artificial Sequence; identical to SEQ ID NO: 1382
  scaffold variant

SEQ ID NO: 3082 - DNA, 107 bp, Artificial Sequence; identical to SEQ ID NO: 1509
  scaffold variant

SEQ ID NO: 3083 - DNA, 107 bp, Artificial Sequence; identical to SEQ ID NO: 1017
  scaffold variant

SEQ ID NO: 3084 - DNA, 107 bp, Artificial Sequence; identical to SEQ ID NO: 2443
  scaffold variant

SEQ ID NO: 3085 - DNA, 107 bp, Artificial Sequence; identical to SEQ ID NO: 1035
  scaffold variant

SEQ ID NO: 3086 - DNA, 109 bp, Artificial Sequence; identical to SEQ ID NO: 1093
  scaffold variant

SEQ ID NO: 3087 - DNA, 107 bp, Artificial Sequence; identical to SEQ ID NO: 878
  scaffold variant

SEQ ID NO: 3088 - DNA, 109 bp, Artificial Sequence; identical to SEQ ID NO: 785
  scaffold variant

SEQ ID NO: 3089 - DNA, 107 bp, Artificial Sequence; identical to SEQ ID NO: 1889
  scaffold variant

SEQ ID NO: 3090 - DNA, 109 bp, Artificial Sequence; identical to SEQ ID NO: 1025
  scaffold variant

SEQ ID NO: 3091 - DNA, 110 bp, Artificial Sequence
  scaffold variant
tactggcgcttttatctcattactttgagagccatcaccagcgactatgtcgtatgggtaaagcgcttatttagtcggagagaaatccgataaataagaagcatcaaagc

SEQ ID NO: 3092 - DNA, 106 bp, Artificial Sequence; identical to SEQ ID NO: 1829
  scaffold variant

SEQ ID NO: 3093 - DNA, 109 bp, Artificial Sequence; identical to SEQ ID NO: 1600
  scaffold variant

SEQ ID NO: 3094 - DNA, 109 bp, Artificial Sequence; identical to SEQ ID NO: 563
  scaffold variant

SEQ ID NO: 3095 - DNA, 109 bp, Artificial Sequence; identical to SEQ ID NO: 2298
  scaffold variant

SEQ ID NO: 3096 - DNA, 108 bp, Artificial Sequence
  scaffold variant
tactggcgcttttatctcattactttgagagccatcaccagcgactatgtcgtatgggtaaagcgcttattttatcggaggaaatccgataaataagaagcatcaaag

SEQ ID NO: 3097 - DNA, 106 bp, Artificial Sequence; identical to SEQ ID NO: 615
  scaffold variant

SEQ ID NO: 3098 - DNA, 106 bp, Artificial Sequence
  scaffold variant
tactggcgcttttatctcattactttgagagccatcaccagcgactatgtcgtatgggtaaagcggtatttatcggagagaatccgataaataagaagcatcaaag

SEQ ID NO: 3099 - DNA, 107 bp, Artificial Sequence; identical to SEQ ID NO: 1307
  scaffold variant

SEQ ID NO: 3100 - DNA, 109 bp, Artificial Sequence
  scaffold variant
tactggcgcctttatctcattactttgagagccatcaccagcgactatgtcgtatgggtaaagcgcttatttatcggagagaaatctcgataaataagaagcatcaaag

SEQ ID NO: 3101 - DNA, 108 bp, Artificial Sequence
  scaffold variant
tactggcgcttttatctcattactttgagagccatcaccagcgactatgtcgtatgggtaaagcgcttatttatcaagagaaatccgataaataagaagcatcaaagc

SEQ ID NO: 3102 - DNA, 107 bp, Artificial Sequence; identical to SEQ ID NO: 1307
  scaffold variant

SEQ ID NO: 3103 - DNA, 106 bp, Artificial Sequence
  scaffold variant
tactggcgcttttatctcattactttgagagccatcaccagcgactatgtcgtatgggtaaagcgcttattttcggagagaatccgataaataagaagcatcaaag

SEQ ID NO: 3104 - DNA, 107 bp, Artificial Sequence; identical to SEQ ID NO: 1382
  scaffold variant

SEQ ID NO: 3105 - DNA, 106 bp, Artificial Sequence; identical to SEQ ID NO: 446
  scaffold variant

SEQ ID NO: 3106 - DNA, 109 bp, Artificial Sequence; identical to SEQ ID NO: 1025
  scaffold variant

SEQ ID NO: 3107 - DNA, 109 bp, Artificial Sequence; identical to SEQ ID NO: 1190
  scaffold variant

SEQ ID NO: 3108 - DNA, 107 bp, Artificial Sequence; identical to SEQ ID NO: 1035
  scaffold variant

SEQ ID NO: 3109 - DNA, 107 bp, Artificial Sequence
  scaffold variant
catggcgcttttatctcattactttgagagccatcaccagcgactatgtcgtatgggtaaagcgcttatttatcggagagaaatccgataaataagaagcatcaaag

SEQ ID NO: 3110 - DNA, 108 bp, Artificial Sequence; identical to SEQ ID NO: 561
  scaffold variant

SEQ ID NO: 3111 - DNA, 108 bp, Artificial Sequence
  scaffold variant
tactggcgcttttatctcattactttgagagccatcaccagcgactatgtcgtatgggtaaagcgcttattttatcggagagtatccgataaataagaagcatcaaag

SEQ ID NO: 3112 - DNA, 107 bp, Artificial Sequence; identical to SEQ ID NO: 1889
  scaffold variant

SEQ ID NO: 3113 - DNA, 109 bp, Artificial Sequence; identical to SEQ ID NO: 2298
  scaffold variant

SEQ ID NO: 3114 - DNA, 107 bp, Artificial Sequence
  scaffold variant
cctggcgcttttatctcattactttgagagcaatcaccagcgactatgtcgtatgggtaaagcgcttatttatcggagagaaatccgataaataagaagcatcaaag

SEQ ID NO: 3115 - DNA, 107 bp, Artificial Sequence
  scaffold variant
tactggcgcttttatctcattactttgagagccatcaccagcgactatgtcgtatgggtaaagcgcttatttatcgagaggaatccgataaataagaagcatcaaag

SEQ ID NO: 3116 - DNA, 107 bp, Artificial Sequence; identical to SEQ ID NO: 1017
  scaffold variant

SEQ ID NO: 3117 - DNA, 107 bp, Artificial Sequence; identical to SEQ ID NO: 1966
  scaffold variant

SEQ ID NO: 3118 - DNA, 109 bp, Artificial Sequence; identical to SEQ ID NO: 1222
  scaffold variant

SEQ ID NO: 3119 - DNA, 107 bp, Artificial Sequence
  scaffold variant
tactggcgcttttatctcattactttgagagccatcaccagcgactatgtcgtatgggtaaagctttatttatcggagagaaatccgataaataagaagcatcaaag

SEQ ID NO: 3120 - DNA, 106 bp, Artificial Sequence
  scaffold variant
tactggcgcttttatctcattactttgagagccatcaccagcgactatgtcgtatgggtaaagcgtatttatcggagagaaatccgataaataagaagcatcaaag

SEQ ID NO: 3121 - DNA, 109 bp, Artificial Sequence; identical to SEQ ID NO: 1228
  scaffold variant

SEQ ID NO: 3122 - DNA, 107 bp, Artificial Sequence; identical to SEQ ID NO: 1723
  scaffold variant

SEQ ID NO: 3123 - DNA, 107 bp, Artificial Sequence; identical to SEQ ID NO: 1307
  scaffold variant

SEQ ID NO: 3124 - DNA, 109 bp, Artificial Sequence
  scaffold variant
tactggcgcttttatctaattactttgagagccatcaccagcgactatgtcgtatgggtaaagcgcttatttattcggagagaaatccgataaataagaagcatcaaag

SEQ ID NO: 3125 - DNA, 106 bp, Artificial Sequence; identical to SEQ ID NO: 539
  scaffold variant

SEQ ID NO: 3126 - DNA, 108 bp, Artificial Sequence; identical to SEQ ID NO: 1924
  scaffold variant

SEQ ID NO: 3127 - DNA, 107 bp, Artificial Sequence; identical to SEQ ID NO: 1136
  scaffold variant

SEQ ID NO: 3128 - DNA, 106 bp, Artificial Sequence; identical to SEQ ID NO: 1979
  scaffold variant

SEQ ID NO: 3129 - DNA, 109 bp, Artificial Sequence; identical to SEQ ID NO: 1025
  scaffold variant

SEQ ID NO: 3130 - DNA, 106 bp, Artificial Sequence; identical to SEQ ID NO: 1829
  scaffold variant

SEQ ID NO: 3131 - DNA, 109 bp, Artificial Sequence; identical to SEQ ID NO: 1222
  scaffold variant

SEQ ID NO: 3132 - DNA, 109 bp, Artificial Sequence
  scaffold variant
tactggcgcttttatctcattactttgagagccatcaccagcgactatgtcgtatgggtaaagcgcttatttatgcggagaggaatccgataaataagaagcatcaaag

SEQ ID NO: 3133 - DNA, 107 bp, Artificial Sequence; identical to SEQ ID NO: 1307
  scaffold variant

SEQ ID NO: 3134 - DNA, 107 bp, Artificial Sequence
  scaffold variant
tactggcgcttttatctcattactttgagagccatcaccagcgactatgtcgtatgggtaaagcgcttatttatcgagggaaatccgataaataagaagcatcaaag

SEQ ID NO: 3135 - DNA, 106 bp, Artificial Sequence; identical to SEQ ID NO: 676
  scaffold variant

SEQ ID NO: 3136 - DNA, 107 bp, Artificial Sequence
  scaffold variant
tactggcgcttttatctcattactttgagagccatcaccagcgactatgtcgtatgggtaaagcgcttatttatatagagaaatccgataaataagaagcatcaaag

SEQ ID NO: 3137 - DNA, 109 bp, Artificial Sequence; identical to SEQ ID NO: 1228
  scaffold variant

SEQ ID NO: 3138 - DNA, 107 bp, Artificial Sequence; identical to SEQ ID NO: 1736
  scaffold variant

SEQ ID NO: 3139 - DNA, 107 bp, Artificial Sequence; identical to SEQ ID NO: 1382
  scaffold variant

SEQ ID NO: 3140 - DNA, 109 bp, Artificial Sequence
  scaffold variant
tactggcgcttttatctcattactttgagagccatcaccagcgactatgtcgtatgggtaaagcgcttatttatcctgagagaaatccgataaataagaagcatcaaag

SEQ ID NO: 3141 - DNA, 107 bp, Artificial Sequence; identical to SEQ ID NO: 1736
  scaffold variant

SEQ ID NO: 3142 - DNA, 107 bp, Artificial Sequence; identical to SEQ ID NO: 2458
  scaffold variant

SEQ ID NO: 3143 - DNA, 106 bp, Artificial Sequence; identical to SEQ ID NO: 1829
  scaffold variant

SEQ ID NO: 3144 - DNA, 107 bp, Artificial Sequence
  scaffold variant
tactggcgcttttatctcattactttgagagccatcaccagcgactatgtcgtatgggtaaagcgcttatttatcgagagaaatccgataaataagaagcataaaag

SEQ ID NO: 3145 - DNA, 109 bp, Artificial Sequence; identical to SEQ ID NO: 2298
  scaffold variant

SEQ ID NO: 3146 - DNA, 109 bp, Artificial Sequence; identical to SEQ ID NO: 1025
  scaffold variant

SEQ ID NO: 3147 - DNA, 107 bp, Artificial Sequence; identical to SEQ ID NO: 1142
  scaffold variant

SEQ ID NO: 3148 - DNA, 110 bp, Artificial Sequence
  scaffold variant
taactggcgcttttatctcattactttgagagccatcaccagcgactatgtcgtatgggtaaagcgcttattctatcggagagaaatccgataaataagaagcatcaaag

SEQ ID NO: 3149 - DNA, 107 bp, Artificial Sequence; identical to SEQ ID NO: 1889
  scaffold variant

SEQ ID NO: 3150 - DNA, 109 bp, Artificial Sequence; identical to SEQ ID NO: 1025
  scaffold variant

SEQ ID NO: 3151 - DNA, 109 bp, Artificial Sequence; identical to SEQ ID NO: 563
  scaffold variant

SEQ ID NO: 3152 - DNA, 106 bp, Artificial Sequence
  scaffold variant
tactggcgcttttatctcattactttgagagccatcaccagcgactatgtcgtatgggtaaagcgcttatttatggagagaaatcgataaataagaagcatcaaag

SEQ ID NO: 3153 - DNA, 109 bp, Artificial Sequence; identical to SEQ ID NO: 957
  scaffold variant

SEQ ID NO: 3154 - DNA, 107 bp, Artificial Sequence
  scaffold variant
cctggcgcttttatcttattactttgagagccatcaccagcgactatgtcgtatgggtaaagcgcttatttatcggagagaaatccgataaataagaagcatcaaag

SEQ ID NO: 3155 - DNA, 109 bp, Artificial Sequence; identical to SEQ ID NO: 955
  scaffold variant

SEQ ID NO: 3156 - DNA, 109 bp, Artificial Sequence; identical to SEQ ID NO: 847
  scaffold variant

SEQ ID NO: 3157 - DNA, 107 bp, Artificial Sequence; identical to SEQ ID NO: 1802
  scaffold variant

SEQ ID NO: 3158 - DNA, 107 bp, Artificial Sequence; identical to SEQ ID NO: 1017
  scaffold variant

SEQ ID NO: 3159 - DNA, 107 bp, Artificial Sequence; identical to SEQ ID NO: 1307
  scaffold variant

SEQ ID NO: 3160 - DNA, 109 bp, Artificial Sequence; identical to SEQ ID NO: 1025
  scaffold variant

SEQ ID NO: 3161 - DNA, 107 bp, Artificial Sequence; identical to SEQ ID NO: 1723
  scaffold variant

SEQ ID NO: 3162 - DNA, 109 bp, Artificial Sequence; identical to SEQ ID NO: 2711
  scaffold variant

SEQ ID NO: 3163 - DNA, 107 bp, Artificial Sequence; identical to SEQ ID NO: 1035
  scaffold variant

SEQ ID NO: 3164 - DNA, 109 bp, Artificial Sequence; identical to SEQ ID NO: 847
  scaffold variant

SEQ ID NO: 3165 - DNA, 107 bp, Artificial Sequence; identical to SEQ ID NO: 1889
  scaffold variant

SEQ ID NO: 3166 - DNA, 107 bp, Artificial Sequence; identical to SEQ ID NO: 1471
  scaffold variant

SEQ ID NO: 3167 - DNA, 106 bp, Artificial Sequence
  scaffold variant
tactggcgcttttatctcattactttgagagccatcaccagcgactatgtcgtatgggtaaagccttatttatcgagagaaatccgataaataagaagcatcaaag

SEQ ID NO: 3168 - DNA, 107 bp, Artificial Sequence
  scaffold variant
tactggcgcttttatctcattactttgagagccatcaccagcgactatgtcgtatgggtaaagctcttatttatcgagagaaatccgataaataagaagcatcaaag

SEQ ID NO: 3169 - DNA, 107 bp, Artificial Sequence; identical to SEQ ID NO: 1960
  scaffold variant

SEQ ID NO: 3170 - DNA, 109 bp, Artificial Sequence; identical to SEQ ID NO: 2298
  scaffold variant

SEQ ID NO: 3171 - DNA, 107 bp, Artificial Sequence
  scaffold variant
tactggcgcttttatctcattactttgagagccatcaccagcgactatgtcgtatgggtaaagcgcttatttaccgagagaaatccgataaataagaagcatcaaag

SEQ ID NO: 3172 - DNA, 107 bp, Artificial Sequence; identical to SEQ ID NO: 1017
  scaffold variant

SEQ ID NO: 3173 - DNA, 107 bp, Artificial Sequence; identical to SEQ ID NO: 1136
  scaffold variant

SEQ ID NO: 3174 - DNA, 109 bp, Artificial Sequence; identical to SEQ ID NO: 1228
  scaffold variant

SEQ ID NO: 3175 - DNA, 107 bp, Artificial Sequence; identical to SEQ ID NO: 1382
  scaffold variant

SEQ ID NO: 3176 - DNA, 109 bp, Artificial Sequence; identical to SEQ ID NO: 1190
  scaffold variant

SEQ ID NO: 3177 - DNA, 107 bp, Artificial Sequence; identical to SEQ ID NO: 1017
  scaffold variant

SEQ ID NO: 3178 - DNA, 107 bp, Artificial Sequence; identical to SEQ ID NO: 1017
  scaffold variant

SEQ ID NO: 3179 - DNA, 107 bp, Artificial Sequence; identical to SEQ ID NO: 1723
  scaffold variant

SEQ ID NO: 3180 - DNA, 107 bp, Artificial Sequence; identical to SEQ ID NO: 1307
  scaffold variant

SEQ ID NO: 3181 - DNA, 107 bp, Artificial Sequence; identical to SEQ ID NO: 1382
  scaffold variant

SEQ ID NO: 3182 - DNA, 107 bp, Artificial Sequence; identical to SEQ ID NO: 1263
  scaffold variant

SEQ ID NO: 3183 - DNA, 107 bp, Artificial Sequence; identical to SEQ ID NO: 1307
  scaffold variant

SEQ ID NO: 3184 - DNA, 107 bp, Artificial Sequence; identical to SEQ ID NO: 1017
  scaffold variant

SEQ ID NO: 3185 - DNA, 107 bp, Artificial Sequence
  scaffold variant
tactggcgcttttatctcattactttgagagccatcaccagcgactatgtcgtatgggtaaagcgcttatttatcgagagaaatcagataaataagaagcatcaaag

SEQ ID NO: 3186 - DNA, 108 bp, Artificial Sequence
  scaffold variant
tactggcgcttttatctcattactttgagagccatcaccagcgactatgtcgtatgggtaaagcgcttattatatcggagagaatccgataaataagaagcatcaaag

SEQ ID NO: 3187 - DNA, 107 bp, Artificial Sequence; identical to SEQ ID NO: 1966
  scaffold variant

SEQ ID NO: 3188 - DNA, 106 bp, Artificial Sequence
  scaffold variant
tactggcgcttttatctcattactttgagagccatcaccagcgactatgtcgtatgggtaaagcgcttatttgcggagagaaatccataaataagaagcatcaaag

SEQ ID NO: 3189 - DNA, 106 bp, Artificial Sequence
  scaffold variant
tactggcgcttttatctcattactttgagagccatcaccagcgactatgtcgtatgggtaaagcgcttatttatcgggagaaatccataaataagaagcatcaaag

SEQ ID NO: 3190 - DNA, 109 bp, Artificial Sequence
  scaffold variant
tactggcgcttttatctcattactttgagagccatcaccagcgactatgtcgtatgggtaaagcgcttatttattgagagagaaatccgataaataagaagcatcaaag

SEQ ID NO: 3191 - DNA, 107 bp, Artificial Sequence; identical to SEQ ID NO: 1889
  scaffold variant

SEQ ID NO: 3192 - DNA, 107 bp, Artificial Sequence
  scaffold variant
tactggcgcttttatctcattactttgagagccatcaccagcgactatgtcgtatgggtaaagcgcttatttatcgagagaaatacgataaataagaagcatcaaag

SEQ ID NO: 3193 - DNA, 106 bp, Artificial Sequence; identical to SEQ ID NO: 663
  scaffold variant

SEQ ID NO: 3194 - DNA, 109 bp, Artificial Sequence; identical to SEQ ID NO: 1228
  scaffold variant

SEQ ID NO: 3195 - DNA, 109 bp, Artificial Sequence; identical to SEQ ID NO: 847
  scaffold variant

SEQ ID NO: 3196 - DNA, 107 bp, Artificial Sequence; identical to SEQ ID NO: 878
  scaffold variant

SEQ ID NO: 3197 - DNA, 107 bp, Artificial Sequence; identical to SEQ ID NO: 878
  scaffold variant

SEQ ID NO: 3198 - DNA, 107 bp, Artificial Sequence; identical to SEQ ID NO: 1889
  scaffold variant

SEQ ID NO: 3199 - DNA, 107 bp, Artificial Sequence; identical to SEQ ID NO: 1471
  scaffold variant

SEQ ID NO: 3200 - DNA, 107 bp, Artificial Sequence; identical to SEQ ID NO: 1263
  scaffold variant

SEQ ID NO: 3201 - DNA, 107 bp, Artificial Sequence; identical to SEQ ID NO: 1136
  scaffold variant

SEQ ID NO: 3202 - DNA, 110 bp, Artificial Sequence
  scaffold variant
tactggcgcttttatctcattactttgagagccatcaccagcgactatgtcgtatgggtaaagcgcttatttatccggagagaaatccgcataaataagaagcatcaaag

SEQ ID NO: 3203 - DNA, 109 bp, Artificial Sequence; identical to SEQ ID NO: 1055
  scaffold variant

SEQ ID NO: 3204 - DNA, 107 bp, Artificial Sequence; identical to SEQ ID NO: 1966
  scaffold variant

SEQ ID NO: 3205 - DNA, 107 bp, Artificial Sequence; identical to SEQ ID NO: 878
  scaffold variant

SEQ ID NO: 3206 - DNA, 107 bp, Artificial Sequence; identical to SEQ ID NO: 1307
  scaffold variant

SEQ ID NO: 3207 - DNA, 107 bp, Artificial Sequence; identical to SEQ ID NO: 1802
  scaffold variant

SEQ ID NO: 3208 - DNA, 109 bp, Artificial Sequence; identical to SEQ ID NO: 955
  scaffold variant

SEQ ID NO: 3209 - DNA, 106 bp, Artificial Sequence; identical to SEQ ID NO: 1829
  scaffold variant

SEQ ID NO: 3210 - DNA, 109 bp, Artificial Sequence; identical to SEQ ID NO: 847
  scaffold variant

SEQ ID NO: 3211 - DNA, 107 bp, Artificial Sequence
  scaffold variant
tactggcgcttttatctcattactttgagagccatcaccagcgactatgtcgtatgggtaaagcgcttatttatcgagagaaatccgataaataagaagaatcaaag

SEQ ID NO: 3212 - DNA, 107 bp, Artificial Sequence; identical to SEQ ID NO: 1802
  scaffold variant

SEQ ID NO: 3213 - DNA, 107 bp, Artificial Sequence; identical to SEQ ID NO: 878
  scaffold variant

SEQ ID NO: 3214 - DNA, 109 bp, Artificial Sequence
  scaffold variant
tactggcgcttttatctcattactttgagagccatcaccagcgactatgtcgtattggtaaagcgcttatttatgcggagagaaatccgataaataagaagcatcaaag

SEQ ID NO: 3215 - DNA, 108 bp, Artificial Sequence; identical to SEQ ID NO: 518
  scaffold variant

SEQ ID NO: 3216 - DNA, 109 bp, Artificial Sequence; identical to SEQ ID NO: 847
  scaffold variant

SEQ ID NO: 3217 - DNA, 107 bp, Artificial Sequence; identical to SEQ ID NO: 1382
  scaffold variant

SEQ ID NO: 3218 - DNA, 107 bp, Artificial Sequence; identical to SEQ ID NO: 1471
  scaffold variant

SEQ ID NO: 3219 - DNA, 107 bp, Artificial Sequence; identical to SEQ ID NO: 1802
  scaffold variant

SEQ ID NO: 3220 - DNA, 109 bp, Artificial Sequence; identical to SEQ ID NO: 1228
  scaffold variant

SEQ ID NO: 3221 - DNA, 108 bp, Artificial Sequence; identical to SEQ ID NO: 421
  scaffold variant

SEQ ID NO: 3222 - DNA, 107 bp, Artificial Sequence; identical to SEQ ID NO: 2458
  scaffold variant

SEQ ID NO: 3223 - DNA, 107 bp, Artificial Sequence; identical to SEQ ID NO: 2458
  scaffold variant

SEQ ID NO: 3224 - DNA, 107 bp, Artificial Sequence; identical to SEQ ID NO: 2443
  scaffold variant

SEQ ID NO: 3225 - DNA, 108 bp, Artificial Sequence
  scaffold variant
tactggcgcttttatctcattactttgagagccatcaccagcgactatgtcgtatgggtaaagcgcttatttacggagagaaatccgataaataagaagcatcaaagc

SEQ ID NO: 3226 - DNA, 107 bp, Artificial Sequence
  scaffold variant
cctggcgcttttatctcattactttgagagccatcaccagcgactatgtcgtatggttaaagcgcttatttatcggagagaaatccgataaataagaagcatcaaag

SEQ ID NO: 3227 - DNA, 106 bp, Artificial Sequence; identical to SEQ ID NO: 1829
  scaffold variant

SEQ ID NO: 3228 - DNA, 107 bp, Artificial Sequence; identical to SEQ ID NO: 1736
  scaffold variant

SEQ ID NO: 3229 - DNA, 107 bp, Artificial Sequence; identical to SEQ ID NO: 1889
  scaffold variant

SEQ ID NO: 3230 - DNA, 109 bp, Artificial Sequence; identical to SEQ ID NO: 1228
  scaffold variant

SEQ ID NO: 3231 - DNA, 109 bp, Artificial Sequence; identical to SEQ ID NO: 955
  scaffold variant

SEQ ID NO: 3232 - DNA, 107 bp, Artificial Sequence; identical to SEQ ID NO: 1889
  scaffold variant

SEQ ID NO: 3233 - DNA, 107 bp, Artificial Sequence; identical to SEQ ID NO: 2458
  scaffold variant

SEQ ID NO: 3234 - DNA, 107 bp, Artificial Sequence
  scaffold variant
tactggcgcttttatctaattactttgagagccatcaccagcgactatgtcgtatgggtaaagcgcttattttcggagagaaatccgataaataagaagcatcaaag

SEQ ID NO: 3235 - DNA, 107 bp, Artificial Sequence; identical to SEQ ID NO: 1802
  scaffold variant

SEQ ID NO: 3236 - DNA, 107 bp, Artificial Sequence; identical to SEQ ID NO: 1736
  scaffold variant

SEQ ID NO: 3237 - DNA, 107 bp, Artificial Sequence; identical to SEQ ID NO: 1307
  scaffold variant

SEQ ID NO: 3238 - DNA, 107 bp, Artificial Sequence; identical to SEQ ID NO: 878
  scaffold variant

SEQ ID NO: 3239 - DNA, 107 bp, Artificial Sequence; identical to SEQ ID NO: 1802
  scaffold variant

SEQ ID NO: 3240 - DNA, 107 bp, Artificial Sequence; identical to SEQ ID NO: 1142
  scaffold variant

SEQ ID NO: 3241 - DNA, 107 bp, Artificial Sequence; identical to SEQ ID NO: 1889
  scaffold variant

SEQ ID NO: 3242 - DNA, 107 bp, Artificial Sequence; identical to SEQ ID NO: 1471
  scaffold variant

SEQ ID NO: 3243 - DNA, 107 bp, Artificial Sequence; identical to SEQ ID NO: 878
  scaffold variant

SEQ ID NO: 3244 - DNA, 107 bp, Artificial Sequence; identical to SEQ ID NO: 1960
  scaffold variant

SEQ ID NO: 3245 - DNA, 107 bp, Artificial Sequence; identical to SEQ ID NO: 1736
  scaffold variant

SEQ ID NO: 3246 - DNA, 109 bp, Artificial Sequence; identical to SEQ ID NO: 1025
  scaffold variant

SEQ ID NO: 3247 - DNA, 107 bp, Artificial Sequence; identical to SEQ ID NO: 1802
  scaffold variant

SEQ ID NO: 3248 - DNA, 107 bp, Artificial Sequence; identical to SEQ ID NO: 1471
  scaffold variant

SEQ ID NO: 3249 - DNA, 107 bp, Artificial Sequence; identical to SEQ ID NO: 1509
  scaffold variant

SEQ ID NO: 3250 - DNA, 107 bp, Artificial Sequence; identical to SEQ ID NO: 1081
  scaffold variant

SEQ ID NO: 3251 - DNA, 109 bp, Artificial Sequence; identical to SEQ ID NO: 847
  scaffold variant

SEQ ID NO: 3252 - DNA, 107 bp, Artificial Sequence; identical to SEQ ID NO: 1382
  scaffold variant

SEQ ID NO: 3253 - DNA, 107 bp, Artificial Sequence; identical to SEQ ID NO: 1081
  scaffold variant

SEQ ID NO: 3254 - DNA, 109 bp, Artificial Sequence; identical to SEQ ID NO: 1049
  scaffold variant

SEQ ID NO: 3255 - DNA, 107 bp, Artificial Sequence; identical to SEQ ID NO: 1889
  scaffold variant

SEQ ID NO: 3256 - DNA, 107 bp, Artificial Sequence; identical to SEQ ID NO: 1263
  scaffold variant

SEQ ID NO: 3257 - DNA, 107 bp, Artificial Sequence; identical to SEQ ID NO: 1802
  scaffold variant

SEQ ID NO: 3258 - DNA, 107 bp, Artificial Sequence; identical to SEQ ID NO: 1035
  scaffold variant

SEQ ID NO: 3259 - DNA, 109 bp, Artificial Sequence; identical to SEQ ID NO: 957
  scaffold variant

SEQ ID NO: 3260 - DNA, 107 bp, Artificial Sequence; identical to SEQ ID NO: 1307
  scaffold variant

SEQ ID NO: 3261 - DNA, 109 bp, Artificial Sequence; identical to SEQ ID NO: 957
  scaffold variant

SEQ ID NO: 3262 - DNA, 107 bp, Artificial Sequence; identical to SEQ ID NO: 1307
  scaffold variant

SEQ ID NO: 3263 - DNA, 108 bp, Artificial Sequence; identical to SEQ ID NO: 518
  scaffold variant

SEQ ID NO: 3264 - DNA, 107 bp, Artificial Sequence
  scaffold variant
tactggcgcttttatctcattactttgagagccatcaccagcgactatgtcgtatgggtaaagcgcttatttatctggagaaatccgataaataagaagcatcaaag

SEQ ID NO: 3265 - DNA, 107 bp, Artificial Sequence
  scaffold variant
tactggcgcttttatctcattactttgagagccataaccagcgactatgtcgtatgggtaaagcgcttatttatcaagagaaatccgataaataagaagcatcaaag

SEQ ID NO: 3266 - DNA, 107 bp, Artificial Sequence; identical to SEQ ID NO: 1966
  scaffold variant

SEQ ID NO: 3267 - DNA, 108 bp, Artificial Sequence
  scaffold variant
tactggcgcttttatctcattactttgagagccatcaccagcgactatgtcgtatgggtaaagcgcttatttacggagagaaatccgcataaataagaagcatcaaag

SEQ ID NO: 3268 - DNA, 109 bp, Artificial Sequence; identical to SEQ ID NO: 1190
  scaffold variant

SEQ ID NO: 3269 - DNA, 107 bp, Artificial Sequence; identical to SEQ ID NO: 1081
  scaffold variant

SEQ ID NO: 3270 - DNA, 107 bp, Artificial Sequence
  scaffold variant
tactggctcttttatctcattactttgagagccatcaccagcgactatgtcgtatgggtaaagcgcttatttatcgagagaaatccgataaataagaagcatcaaag

SEQ ID NO: 3271 - DNA, 107 bp, Artificial Sequence; identical to SEQ ID NO: 1723
  scaffold variant

SEQ ID NO: 3272 - DNA, 109 bp, Artificial Sequence
  scaffold variant
tactggcgcttttatctcattactttgagagccatcaccagcgactatgtcgtatgggtaaagcgcttatttataggagagaaatcgcgataaataagaagcatcaaag

SEQ ID NO: 3273 - DNA, 107 bp, Artificial Sequence; identical to SEQ ID NO: 2458
  scaffold variant

SEQ ID NO: 3274 - DNA, 109 bp, Artificial Sequence; identical to SEQ ID NO: 1600
  scaffold variant

SEQ ID NO: 3275 - DNA, 107 bp, Artificial Sequence; identical to SEQ ID NO: 1136
  scaffold variant

SEQ ID NO: 3276 - DNA, 107 bp, Artificial Sequence; identical to SEQ ID NO: 1136
  scaffold variant

SEQ ID NO: 3277 - DNA, 107 bp, Artificial Sequence; identical to SEQ ID NO: 1081
  scaffold variant

SEQ ID NO: 3278 - DNA, 107 bp, Artificial Sequence; identical to SEQ ID NO: 1081
  scaffold variant

SEQ ID NO: 3279 - DNA, 107 bp, Artificial Sequence; identical to SEQ ID NO: 1966
  scaffold variant

SEQ ID NO: 3280 - DNA, 107 bp, Artificial Sequence; identical to SEQ ID NO: 1966
  scaffold variant

SEQ ID NO: 3281 - DNA, 107 bp, Artificial Sequence; identical to SEQ ID NO: 878
  scaffold variant

SEQ ID NO: 3282 - DNA, 109 bp, Artificial Sequence; identical to SEQ ID NO: 1025
  scaffold variant

SEQ ID NO: 3283 - DNA, 109 bp, Artificial Sequence; identical to SEQ ID NO: 847
  scaffold variant

SEQ ID NO: 3284 - DNA, 107 bp, Artificial Sequence
  scaffold variant
tactggcgcttttatctcattactttgagagccatcaccagcgactatgtagtatgggtaaagcgcttatttatcgagagaaatccgataaataagaagcatcaaag

SEQ ID NO: 3285 - DNA, 107 bp, Artificial Sequence; identical to SEQ ID NO: 1802
  scaffold variant

SEQ ID NO: 3286 - DNA, 107 bp, Artificial Sequence; identical to SEQ ID NO: 1081
  scaffold variant

SEQ ID NO: 3287 - DNA, 107 bp, Artificial Sequence; identical to SEQ ID NO: 1081
  scaffold variant

SEQ ID NO: 3288 - DNA, 107 bp, Artificial Sequence; identical to SEQ ID NO: 1966
  scaffold variant

SEQ ID NO: 3289 - DNA, 107 bp, Artificial Sequence; identical to SEQ ID NO: 1736
  scaffold variant

SEQ ID NO: 3290 - DNA, 107 bp, Artificial Sequence
  scaffold variant
tactggcgcttttatctaattactttgagagccatcaccagcgactatgtcgtatgggtaaagcgcttatttatcggagagaaatcgataaataagaagcatcaaag

SEQ ID NO: 3291 - DNA, 107 bp, Artificial Sequence; identical to SEQ ID NO: 1966
  scaffold variant

SEQ ID NO: 3292 - DNA, 107 bp, Artificial Sequence
  scaffold variant
tactggcgcttttatctcattactttgagagccatcaccagcgactatgtcgtatgggtaaagcgcttatttatcgggggaaatccgataaataagaagcatcaaag

SEQ ID NO: 3293 - DNA, 107 bp, Artificial Sequence; identical to SEQ ID NO: 1081
  scaffold variant

SEQ ID NO: 3294 - DNA, 107 bp, Artificial Sequence; identical to SEQ ID NO: 1263
  scaffold variant

SEQ ID NO: 3295 - DNA, 109 bp, Artificial Sequence; identical to SEQ ID NO: 957
  scaffold variant

SEQ ID NO: 3296 - DNA, 47 bp, Artificial Sequence
  TTC protospacer adjacent motif
  misc_feature (1)..(2): n is any nucleotide
  misc_feature (6)..(47): n is any nucleotide
  misc_feature (21)..(42): These individual nucleotides may be absent
nnttcnnnnnnnnnnnnnnnnnnnnnnnnnnnnnnnnnnnnnnnnnn

SEQ ID NO: 3297 - DNA, 47 bp, Artificial Sequence
  CTC protospacer adjacent motif
  misc_feature (1)..(2): n is any nucleotide
  misc_feature (6)..(47): n is any nucleotide
  misc_feature (21)..(42): These individual nucleotides may be absent
nnctcnnnnnnnnnnnnnnnnnnnnnnnnnnnnnnnnnnnnnnnnnn

SEQ ID NO: 3298 - DNA, 47 bp, Artificial Sequence
  GTC protospacer adjacent motif
  misc_feature (1)..(2): n is any nucleotide
  misc_feature (6)..(47): n is any nucleotide
  misc_feature (21)..(42): These individual nucleotides may be absent
nngtcnnnnnnnnnnnnnnnnnnnnnnnnnnnnnnnnnnnnnnnnnn

SEQ ID NO: 3299 - DNA, 47 bp, Artificial Sequence
  ATC protospacer adjacent motif
  misc_feature (1)..(2): n is any nucleotide
  misc_feature (6)..(47): n is any nucleotide
  misc_feature (21)..(42): These individual nucleotides may be absent
nnatcnnnnnnnnnnnnnnnnnnnnnnnnnnnnnnnnnnnnnnnnnn

SEQ ID NO: 3300 - DNA, 47 bp, Artificial Sequence
  TC protospacer adjacent motif
  misc_feature (1)..(3): n is any nucleotide
  misc_feature (6)..(47): n is any nucleotide
  misc_feature (21)..(42): These individual nucleotides may be absent
nnntcnnnnnnnnnnnnnnnnnnnnnnnnnnnnnnnnnnnnnnnnnn

SEQ ID NO: 3301 - protein, 977 aa, Artificial Sequence; identical to SEQ ID NO: 258
  CasX Protein Variant

SEQ ID NO: 3302 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3303 - protein, 977 aa, Artificial Sequence; identical to SEQ ID NO: 260
  CasX Protein Variant

SEQ ID NO: 3304 - protein, 978 aa, Artificial Sequence; identical to SEQ ID NO: 261
  CasX Protein Variant

SEQ ID NO: 3305 - protein, 978 aa, Artificial Sequence; identical to SEQ ID NO: 262
  CasX Protein Variant

SEQ ID NO: 3306 - protein, 978 aa, Artificial Sequence; identical to SEQ ID NO: 263
  CasX Protein Variant

SEQ ID NO: 3307 - protein, 977 aa, Artificial Sequence; identical to SEQ ID NO: 264
  CasX Protein Variant

SEQ ID NO: 3308 - protein, 977 aa, Artificial Sequence; identical to SEQ ID NO: 265
  CasX Protein Variant

SEQ ID NO: 3309 - protein, 977 aa, Artificial Sequence; identical to SEQ ID NO: 266
  CasX Protein Variant

SEQ ID NO: 3310 - protein, 977 aa, Artificial Sequence; identical to SEQ ID NO: 267
  CasX Protein Variant

SEQ ID NO: 3311 - protein, 978 aa, Artificial Sequence; identical to SEQ ID NO: 268
  CasX Protein Variant

SEQ ID NO: 3312 - protein, 977 aa, Artificial Sequence; identical to SEQ ID NO: 269
  CasX Protein Variant

SEQ ID NO: 3313 - protein, 977 aa, Artificial Sequence; identical to SEQ ID NO: 270
  CasX Protein Variant

SEQ ID NO: 3314 - protein, 977 aa, Artificial Sequence; identical to SEQ ID NO: 271
  CasX Protein Variant

SEQ ID NO: 3315 - protein, 977 aa, Artificial Sequence; identical to SEQ ID NO: 272
  CasX Protein Variant

SEQ ID NO: 3316 - protein, 977 aa, Artificial Sequence; identical to SEQ ID NO: 273
  CasX Protein Variant

SEQ ID NO: 3317 - protein, 978 aa, Artificial Sequence; identical to SEQ ID NO: 274
  CasX Protein Variant

SEQ ID NO: 3318 - protein, 978 aa, Artificial Sequence; identical to SEQ ID NO: 275
  CasX Protein Variant

SEQ ID NO: 3319 - protein, 977 aa, Artificial Sequence; identical to SEQ ID NO: 276
  CasX Protein Variant

SEQ ID NO: 3320 - protein, 977 aa, Artificial Sequence; identical to SEQ ID NO: 277
  CasX Protein Variant

SEQ ID NO: 3321 - protein, 977 aa, Artificial Sequence; identical to SEQ ID NO: 278
  CasX Protein Variant

SEQ ID NO: 3322 - protein, 978 aa, Artificial Sequence; identical to SEQ ID NO: 279
  CasX Protein Variant

SEQ ID NO: 3323 - protein, 978 aa, Artificial Sequence; identical to SEQ ID NO: 280
  CasX Protein Variant

SEQ ID NO: 3324 - protein, 977 aa, Artificial Sequence; identical to SEQ ID NO: 281
  CasX Protein Variant

SEQ ID NO: 3325 - protein, 978 aa, Artificial Sequence; identical to SEQ ID NO: 282
  CasX Protein Variant

SEQ ID NO: 3326 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEMLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3327 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSERDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3328 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3329 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3330 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFAANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3331 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3332 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRNEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3333 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLGSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3334 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3335 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGKPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3336 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3337 - protein, 980 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTASYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3338 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFHRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3339 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3340 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDWLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3341 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3342 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3343 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARMWLFLRSQEYKKYQTNKTTGNTDKRAFVETWQSFYRKKLKEVWKPAV

SEQ ID NO: 3344 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3345 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3346 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAQKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3347 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNKNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3348 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3349 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFQRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3350 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAAYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3351 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3352 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3353 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEMLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3354 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADTMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3355 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLQSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3356 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3357 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3358 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYSKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3359 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEKRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3360 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3361 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3362 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFRRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3363 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTTRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3364 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNRCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3365 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGEVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3366 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3367 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSKEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3368 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIHESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3369 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3370 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIRAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3371 - protein, 978 aa, Artificial Sequence; identical to SEQ ID NO: 3335
  CasX Protein Variant

SEQ ID NO: 3372 - protein, 978 aa, Artificial Sequence
  CasX Protein Variant
MQEIKRINKIRRRLVKDSNTKKAGRTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3373 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWRPAV

SEQ ID NO: 3374 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFMETWQSFYRKKLKEVWKPAV

SEQ ID NO: 3375 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3376 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSSTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3377 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGTTDKRAFVETWQSFYRKKLKEVWKPAV

SEQ ID NO: 3378 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWQPAV

SEQ ID NO: 3379 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRRGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3380 - protein, 977 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3381 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLWYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3382 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERRENEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3383 - protein, 978 aa, Artificial Sequence
  CasX Protein Variant
MQEIKRFNKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3384 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYKINKTTGNTDKRAFVETWQSFYRKKLKEVWKPAV

SEQ ID NO: 3385 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFEDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3386 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSAEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3387 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3388 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSQEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3389 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLANDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3390 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIKAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3391 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPRKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3392 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEMLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3393 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVKWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3394 - protein, 980 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLASPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3395 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLGLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3396 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3397 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEKLLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3398 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDRRAFVETWQSFYRKKLKEVWKPAV

SEQ ID NO: 3399 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWKKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3400 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERRKNEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3401 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPQQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3402 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNNLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3403 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLRVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3404 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIHGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3405 - protein, 978 aa, Artificial Sequence
  CasX Protein Variant
MQEIKRINKIRRRLVKDSNTKKAGKTGPMKTLLVRVMTPDLRERLENLRKKPKNIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3406 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGEPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3407 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERRANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3408 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPDTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3409 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKGIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3410 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKPPGNTDKRAFVETWQSFYRKKLKEVWKPAV

SEQ ID NO: 3411 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKFTLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3412 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLMKKRFSHRPVQEKFVCLNCGFETHADEQAALNIARSWLFLRSQEYKKYQTNKTTGNTDKRAFVETWQSFYRKKLKEVWKPAV

SEQ ID NO: 3413 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKRGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3414 - protein, 978 aa, Artificial Sequence; identical to SEQ ID NO: 3413
  CasX Protein Variant

SEQ ID NO: 3415 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGGPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3416 - protein, 978 aa, Artificial Sequence; identical to SEQ ID NO: 3356
  CasX Protein Variant

SEQ ID NO: 3417 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNGRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3418 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVENVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3419 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIKAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3420 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDQKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3421 - protein, 978 aa, Artificial Sequence
  CasX Protein Variant
MQEIKRINKIRRRLVKDSNTKKAGKTGPMKTLLVRVMTPDLRERLENLRKKPENFPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3422 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVQQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3423 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDKFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3424 - protein, 980 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKASTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3425 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTREDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3426 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRAELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3427 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVEREANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3428 - protein, 978 aa, Artificial Sequence
  CasX Protein Variant
MQEIKRINKIRRRLVKDSNTKKAGQTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3429 - protein, 980 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSASKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3430 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCEQKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3431 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFKANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3432 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHINYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3433 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNDDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3434 - protein, 978 aa, Artificial Sequence; identical to SEQ ID NO: 3392
  CasX Protein Variant

SEQ ID NO: 3435 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDASMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3436 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWKNLAGYKRQEALLPYLSSEEDRKKGKKFARYQFGDLLLHLEKKHGEDWGKVYDEAWERSDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3437 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSIGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3438 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYQKYQTNKTTGNTDKRAFVETWQSFYRKKLKEVWKPAV

SEQ ID NO: 3439 - protein, 978 aa, Artificial Sequence
  CasX Protein Variant
MQEIKRINKIRRRLVKDSNTKKAGKTGPMKTLLVRVMTPDLRERLEDLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3440 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFMALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3441 - protein, 978 aa, Artificial Sequence
  CasX Protein Variant
MQEIKRINKIRRRLVKDSNTKKAGKTDPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3442 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRLELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3443 - protein, 979 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLASSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3444 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLSDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3445 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIAWANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3446 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDSMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3447 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVARPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3448 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDKVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3449 - protein, 980 aa, Artificial Sequence; identical to SEQ ID NO: 3429
  CasX Protein Variant

SEQ ID NO: 3450 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKYGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3451 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSRTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3452 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVDLTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3453 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGEVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3454 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILIIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3455 - protein, 978 aa, Artificial Sequence
  CasX Protein Variant
MQEIKRINKIRRRLVKDSNTKKAGKTGPRKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3456 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQPNKTTGNTDKRAFVETWQSFYRKKLKEVWKPAV

SEQ ID NO: 3457 - protein, 979 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGLRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3458 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNDRLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3459 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGKVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3460 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGRRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3461 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCKLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3462 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKVKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3463 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGEFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3464 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLATEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3465 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPSAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3466 - protein, 978 aa, Artificial Sequence
  CasX Protein Variant
MQEIKRINKIRRRLVKDSNTKKAGKTGPEKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3467 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVTSFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3468 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSNACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3469 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSFHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3470 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRSTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3471 - protein, 979 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRAGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3472 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRANASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3473 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVRPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3474 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRPKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3475 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKIQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3476 - protein, 979 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGTESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3477 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDIGRFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3478 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKNASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3479 - protein, 979 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGPESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3480 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVRKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3481 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVGKPAV

SEQ ID NO: 3482 - protein, 979 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAMERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3483 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKRIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3484 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYSSKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3485 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRKIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3486 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFNRKKLKEVWKPAV

SEQ ID NO: 3487 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSERERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3488 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRIYTVINKKSGEIVPMEVNFNFDDPNLIILPLAFGKRQGREFIWNDLLSLETGSLKLANGRVIEKTLYNRRTRQDEPALFVALTFERREVLASSNIKPMNLIGIDRGENIPAVIALTDPEGCPLSRFKDSLGNPTHILRIDESYKEKQRTIQAAKEVEQRRAGGYSRKYASKAKNLADDMVRNTARDLLYYAVTQDSMLIFENLSRGFGRQGKRTFMAERQYTRMEDWLTAKLAYEGLPSKTYLSKTLAQYTSKTCSNCGFTITSPDYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3489 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIHRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3490 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYVSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3491 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLADEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3492 - protein, 978 aa, Artificial Sequence; identical to SEQ ID NO: 3426
  CasX Protein Variant

SEQ ID NO: 3493 - protein, 978 aa, Artificial Sequence
  CasX Protein Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPPEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3494 - DNA, 3120 bp, Artificial Sequence
  CasX construct WT Cas X sequence of SEQ ID NO: 2 fused to an N terminal NLS
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcttccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcagccaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgccgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaaaaaactgaaagaggtctggaaaccggcggtagcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 3495 - DNA, 3123 bp, Artificial Sequence
  CasX construct CasX 119
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 3496 - DNA, 3123 bp, Artificial Sequence
  CasX construct CasX 438
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcagaagaagatcgcaaaaaaggcaagaagtttgctcgctatcagttgggcgatttattaaagcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtgttgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgtcgtaagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 3497 - DNA, 3123 bp, Artificial Sequence
  CasX construct CasX 457
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcataagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcaccagaagatcgcaaaaaaggcaagaagtttgctcgctatcagttgggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaccgctctacaaccgccgcacccgccaggatgagccggcactgtttgtcgcgctgacctttgaacggcgtgaagtcctcgatagcagcaacatcaaaccaatgaaccttatcggtgttgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgtcgtaagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 3498 - protein, 1039 aa, Artificial Sequence
  CasX construct WT Cas X sequence of SEQ ID NO: 2 fused to an N terminal NLS
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVAPKKKRKVSENLYFQGSAWSHPQFEKGGGSGGGSGGSAWSHPQFEKGRGSGC

SEQ ID NO: 3499 - protein, 1040 aa, Artificial Sequence
  CasX construct CasX 119
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVPPAPKKKRKVSENLYFQGSAWSHPQFEKGGGSGGGSGGSAWSHPQFEKGRGSGC

SEQ ID NO: 3500 - protein, 1040 aa, Artificial Sequence
  CasX construct CasX 438
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVPPAPKKKRKVSENLYFQGSAWSHPQFEKGGGSGGGSGGSAWSHPQFEKGRGSGC

SEQ ID NO: 3501 - protein, 1040 aa, Artificial Sequence
  CasX construct CasX 457
MAPKKKRKVSQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVPPAPKKKRKVSENLYFQGSAWSHPQFEKGGGSGGGSGGSAWSHPQFEKGRGSGC

SEQ ID NO: 3502 - DNA, 2928 bp, Artificial Sequence
  CasX construct CasX 119
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 3503 - DNA, 2928 bp, Artificial Sequence
  CasX construct CasX 457
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacacaagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaacccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 3504 - DNA, 2928 bp, Artificial Sequence
  CasX construct CasX 438
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 3505 - protein, 976 aa, Artificial Sequence; identical to SEQ ID NO: 315
  CasX construct CasX 119

SEQ ID NO: 3506 - protein, 976 aa, Artificial Sequence
  CasX construct CasX 457
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3507 - protein, 976 aa, Artificial Sequence
  CasX construct CasX 438
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3508 - protein, 987 aa, Artificial Sequence
  CasX construct CasX 278
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3509 - protein, 986 aa, Artificial Sequence
  CasX construct CasX 279
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3510 - protein, 996 aa, Artificial Sequence
  CasX construct CasX 280
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 3511 - protein, 1006 aa, Artificial Sequence
  CasX construct CasX 285
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPHKKKHPDASVNFSEFSK

SEQ ID NO: 3512 - protein, 1007 aa, Artificial Sequence
  CasX construct CasX 286
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPQRPGPYDRPQRPGPYDRP

SEQ ID NO: 3513 - protein, 1005 aa, Artificial Sequence
  CasX construct CasX 287
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPLSPSLSPLLSPSLSPL

SEQ ID NO: 3514 - protein, 1008 aa, Artificial Sequence
  CasX construct CasX 288
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPRGKGGKGLGKGGAKRHRK

SEQ ID NO: 3515 - protein, 1013 aa, Artificial Sequence
  CasX construct CasX 290
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPSRRRKANPTKLSENAKKLAKEVEN

SEQ ID NO: 3516 - protein, 998 aa, Artificial Sequence
  CasX construct CasX 291
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 3517 - protein, 997 aa, Artificial Sequence
  CasX construct CasX 293
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRSFSKAF

SEQ ID NO: 3518 - protein, 1008 aa, Artificial Sequence
  CasX construct CasX 300
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRGINDRNFWRGENERKTR

SEQ ID NO: 3519 - protein, 1007 aa, Artificial Sequence
  CasX construct CasX 492
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 3520 - protein, 1009 aa, Artificial Sequence
  CasX construct CasX 493
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 3521 - DNA, 21 bp, Betapolyomavirus macaca mulatta polyomavirus 1
ccaaagaagaagcggaaggtc

SEQ ID NO: 3522 - DNA, 51 bp, Unknown
  Nuclear localization sequence
cacaagaagaaacatccagacgcatcagtcaactttagcgagttcagtaaa

SEQ ID NO: 3523 - DNA, 54 bp, Unknown
  Nuclear localization sequence
cagcgccctgggccttacgataggccgcaaagacccggaccgtatgatcgccct

SEQ ID NO: 3524 - DNA, 48 bp, Unknown
  Nuclear localization sequence
ctcagcccgagtcttagtccactgctttccccgtccctgtctccactg

SEQ ID NO: 3525 - DNA, 54 bp, Unknown
  Nuclear localization sequence
cggggcaagggtggcaaggggcttggcaaggggggggcaaagaggcacaggaag

SEQ ID NO: 3526 - DNA, 72 bp, Caenorhabditis elegans
agccgccgcagaaaagccaatcctacaaaactgtcagaaaatgcgaaaaaacttgctaaggaggtggaaaac

SEQ ID NO: 3527 - DNA, 27 bp, Homo sapiens
cctgccgcaaagcgagtgaaattggac

SEQ ID NO: 3528 - DNA, 24 bp, Unknown
  Nuclear localization sequence
aagcggtccttcagtaaggccttt

SEQ ID NO: 3529 - DNA, 57 bp, Alphainfluenzavirus influenza A virus
aaacggggaataaacgaccggaacttctggcgcggggaaaacgagcgcaaaacccga

SEQ ID NO: 3530 - DNA, 2991 bp, Artificial Sequence
  CasX 387 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3531 - DNA, 2988 bp, Artificial Sequence
  CasX 395 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3532 - DNA, 2988 bp, Artificial Sequence
  CasX 485 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3533 - DNA, 2988 bp, Artificial Sequence
  CasX 486 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3534 - DNA, 2988 bp, Artificial Sequence
  CasX 487 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3535 - DNA, 2991 bp, Artificial Sequence
  CasX 488 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3536 - DNA, 2991 bp, Artificial Sequence
  CasX 489 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3537 - DNA, 2991 bp, Artificial Sequence
  CasX 490 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3538 - DNA, 2991 bp, Artificial Sequence
  CasX 491 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3539 - DNA, 2991 bp, Artificial Sequence
  CasX 494 construct
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 3540 - protein, 997 aa, Artificial Sequence
  CasX 387 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3541 - protein, 1005 aa, Artificial Sequence
  CasX 395 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVTSPKKKRKV

SEQ ID NO: 3542 - protein, 996 aa, Artificial Sequence
  CasX 485 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3543 - protein, 996 aa, Artificial Sequence
  CasX 486 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3544 - protein, 996 aa, Artificial Sequence
  CasX 487 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3545 - protein, 997 aa, Artificial Sequence
  CasX 488 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3546 - protein, 997 aa, Artificial Sequence
  CasX 489 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3547 - protein, 997 aa, Artificial Sequence
  CasX 490 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3548 - protein, 997 aa, Artificial Sequence
  CasX 491 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3549 - protein, 997 aa, Artificial Sequence
  CasX 494 construct
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 3550 - DNA, 22 bp, Artificial Sequence
  T7 promoter primer
gaaattaatacgactcactata

SEQ ID NO: 3551 - DNA, 87 bp, Artificial Sequence
  sg2 backbone fwd
gaaattaatacgactcactataggtactggcgcttttatctcattactttgagagccatcaccagcgactatgtcgtatgggtaaag

SEQ ID NO: 3552 - DNA, 78 bp, Artificial Sequence
  sg2 backbone rev
ctttgatgcttcttatttatcggatttctctccgataaataagcgctttacccatacgacatagtcgctggtgatggc

SEQ ID NO: 3553 - DNA, 54 bp, Artificial Sequence
  sg2.7.37 spacer primer
cggagcgagacatctcggccctttgatgcttcttatttatcggatttctctccg

SEQ ID NO: 3554 - DNA, 90 bp, Artificial Sequence
  sg32 backbone fwd
gaaattaatacgactcactataggtactggcgcttttatctcattactttgagagccatcaccagcgactatgtcgtatgggtaaagcgc

SEQ ID NO: 3555 - DNA, 46 bp, Artificial Sequence
  sg32 backbone rev
ctttgatgcttccctccgaagagggcgctttacccatacgacatag

SEQ ID NO: 3556 - DNA, 43 bp, Artificial Sequence
  sg32.7.37 spacer primer
cggagcgagacatctcggccctttgatgcttccctccgaagag

SEQ ID NO: 3557 - DNA, 90 bp, Artificial Sequence
  sg64 backbone fwd
gaaattaatacgactcactataggtactggcgcctttatctcattactttgagagccatcaccagcgactatgtcgtatgggtaaagcgc

SEQ ID NO: 3558 - DNA, 54 bp, Artificial Sequence
  sg64 backbone rev
ctttgatgcttcttacggaccgaagtccgtaagcgctttacccatacgacatag

SEQ ID NO: 3559 - DNA, 45 bp, Artificial Sequence
  sg64.7.37 spacer primer
cggagcgagacatctcggccctttgatgcttcttacggaccgaag

SEQ ID NO: 3560 - DNA, 87 bp, Artificial Sequence
  sg174 backbone fwd
gaaattaatacgactcactataactggcgcttttatctgattactttgagagccatcaccagcgactatgtcgtagtgggtaaagct

SEQ ID NO: 3561 - DNA, 50 bp, Artificial Sequence
  sg174 backbone rev
ctttgatgctccctccgaagagggagctttacccactacgacatagtcgc

SEQ ID NO: 3562 - DNA, 36 bp, Artificial Sequence
  sg174.7.37 spacer primer
cggagcgagacatctcggccctttgatgctccctcc

SEQ ID NO: 3563 - RNA, 130 nt, Artificial Sequence
  sg2 RNA product
gguacuggcgcuuuuaucucauuacuuugagagccaucaccagcgacuaugucguauggguaaagcgcuuauuuaucggagagaaauccgauaaauaagaagcaucaaagggccgagaugucucgcuccg

SEQ ID NO: 3564 - RNA, 107 nt, Artificial Sequence
  sg32 RNA product
gguacuggcgcuuuuaucucauuacuuugagagccaucaccagcgacuaugucguauggguaaagcgcccucuucggagggaagcaucaaagggccgagaugucucg

SEQ ID NO: 3565 - RNA, 120 nt, Artificial Sequence
  sg64 RNA product
gguacuggcgccuuuaucucauuacuuugagagccaucaccagcgacuaugucguauggguaaagcgcuuacggacuucgguccguaagaagcaucaaagggccgagaugucucgcuccg

SEQ ID NO: 3566 - RNA, 109 nt, Artificial Sequence
  sg174 RNA product
acuggcgcuuuuaucugauuacuuugagagccaucaccagcgacuaugucguaguggguaaagcucccucuucggagggagcaucaaagggccgagaugucucgcuccg

SEQ ID NO: 3567 - DNA, 60 bp, Artificial Sequence
  beta-2 microglobulin (B2M) non-target strand oligonucleotide
tgaagctgacagcattcgggccgagatgtctcgctccgtggccttagctgtgctcgcgct

SEQ ID NO: 3568 - DNA, 60 bp, Artificial Sequence; identical to SEQ ID NO: 3567
  beta-2 microglobulin (B2M) target strand oligonucleotide

SEQ ID NO: 3569 - DNA, 4667 bp, Artificial Sequence
  pStX17 construct
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggcctctagactcgaggcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactaccggtgccaccatggccccaaagaagaagcggaaggtcagccaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgctgccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccgccaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagattacaaagatgacgatgacaaagactacaaggatgatgatgataagggatcctacccatacgatgttccagattacgcttacccatacgatgttccagattacgcttacccatacgatgttccagattacgcttaagaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggaggtaccgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtactggcgcttttatctcattactttgagagccatcaccagcgactatgtcgtatgggtaaagcgcttatttatcggagagaaatccgataaataagaagcatcaaaggggtcttcgagaagacccttttttttggcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 3570 - DNA, 20 bp, Artificial Sequence
  spacer sequence
gaggaggacggcctggccga

SEQ ID NO: 3571 - DNA, 20 bp, Artificial Sequence
  spacer sequence
accgctgcgccaaggtgcgg

SEQ ID NO: 3572 - DNA, 20 bp, Artificial Sequence
  spacer sequence
gccaggccgtcctcctcgga

SEQ ID NO: 3573 - DNA, 20 bp, Artificial Sequence
  spacer sequence
gtgctcgggtgcttcggcca

SEQ ID NO: 3574 - DNA, 20 bp, Artificial Sequence
  spacer sequence
atggccttcttcctggcttc

SEQ ID NO: 3575 - DNA, 20 bp, Artificial Sequence
  spacer sequence
gcaccaccacgtaggtgcca

SEQ ID NO: 3576 - DNA, 20 bp, Artificial Sequence
  spacer sequence
tcctggcttcctggtgaaga

SEQ ID NO: 3577 - DNA, 20 bp, Artificial Sequence
  spacer sequence
tggcttcctggtgaagatga

SEQ ID NO: 3578 - DNA, 20 bp, Artificial Sequence
  spacer sequence
ccaggaagccaggaagaagg

SEQ ID NO: 3579 - DNA, 20 bp, Artificial Sequence
  spacer sequence
tccttgcatggggccaggat

SEQ ID NO: 3580 - DNA, 20 bp, Artificial Sequence
  spacer sequence
ggcggcaagttctgctcagc

SEQ ID NO: 3581 - DNA, 20 bp, Artificial Sequence
  spacer sequence
tctccacgatcgtcagcgtg

SEQ ID NO: 3582 - DNA, 20 bp, Artificial Sequence
  spacer sequence
acgatcgtcagcgtgagtgc

SEQ ID NO: 3583 - DNA, 20 bp, Artificial Sequence
  spacer sequence
ctctagcaatggatcgtggg

SEQ ID NO: 3584 - DNA, 20 bp, Artificial Sequence
  spacer sequence
caaacaaatgtgtcacaaag

SEQ ID NO: 3585 - DNA, 20 bp, Artificial Sequence
  spacer sequence
gatgtgtatatcacagacaa

SEQ ID NO: 3586 - DNA, 20 bp, Artificial Sequence
  spacer sequence
ggaataatgctgttgttgaa

SEQ ID NO: 3587 - DNA, 20 bp, Artificial Sequence
  spacer sequence
aaatccagtgacaagtctgt

SEQ ID NO: 3588 - DNA, 20 bp, Artificial Sequence
  spacer sequence
aggccacagcactgttgctc

SEQ ID NO: 3589 - DNA, 20 bp, Artificial Sequence
  spacer sequence
agaagacaccttcttcccca

SEQ ID NO: 3590 - DNA, 20 bp, Artificial Sequence
  spacer sequence
tccccagcccaggtaagggc

SEQ ID NO: 3591 - DNA, 20 bp, Artificial Sequence
  spacer sequence
ccagcccaggtaagggcagc

SEQ ID NO: 3592 - DNA, 20 bp, Artificial Sequence
  spacer sequence
agtccctcaagtccttccag

SEQ ID NO: 3593 - DNA, 20 bp, Artificial Sequence
  spacer sequence
agcagcagcagcagcagcag

SEQ ID NO: 3594 - DNA, 20 bp, Artificial Sequence
  spacer sequence
tcagccgccgccgcaggcac

SEQ ID NO: 3595 - DNA, 20 bp, Artificial Sequence
  spacer sequence
agggtcgccatggcggtctc

SEQ ID NO: 3596 - DNA, 20 bp, Artificial Sequence
  spacer sequence
tcagcttttccagggtcgcc

SEQ ID NO: 3597 - DNA, 20 bp, Artificial Sequence
  spacer sequence
gccgcagccgcccccgccgc

SEQ ID NO: 3598 - DNA, 20 bp, Artificial Sequence
  spacer sequence
gccacagccgggccgggtgg

SEQ ID NO: 3599 - DNA, 20 bp, Artificial Sequence
  spacer sequence
tcagccacagccgggccggg

SEQ ID NO: 3600 - DNA, 20 bp, Artificial Sequence
  spacer sequence
cggtcggtgcagcggctcct

SEQ ID NO: 3601 - DNA, 20 bp, Artificial Sequence
  spacer sequence
ccacaccttcactggtccat

SEQ ID NO: 3602 - DNA, 20 bp, Artificial Sequence
  spacer sequence
taaaggaaagtaatggacca

SEQ ID NO: 3603 - DNA, 20 bp, Artificial Sequence
  spacer sequence
ctggtccattactttccttt

SEQ ID NO: 3604 - DNA, 20 bp, Artificial Sequence
  spacer sequence
tgagtttggagataatacag

SEQ ID NO: 3605 - DNA, 20 bp, Artificial Sequence
  spacer sequence
atagacacatcggccacacc

SEQ ID NO: 3606 - DNA, 20 bp, Artificial Sequence
  spacer sequence
ttattaggcatgttggagac

SEQ ID NO: 3607 - DNA, 20 bp, Artificial Sequence
  spacer sequence
caggagaccattgcatcatt

SEQ ID NO: 3608 - DNA, 20 bp, Artificial Sequence
  spacer sequence
ggcctggaggctatccagcg

SEQ ID NO: 3609 - DNA, 20 bp, Artificial Sequence
  spacer sequence
ggccgagatgtctcgctccg

SEQ ID NO: 3610 - DNA, 20 bp, Artificial Sequence
  spacer sequence
aggccagaaagagagagtag

SEQ ID NO: 3611 - DNA, 20 bp, Artificial Sequence
  spacer sequence
cgctggatagcctccaggcc

SEQ ID NO: 3612 - DNA, 20 bp, Artificial Sequence
  spacer sequence
tgaagctgacagcattcggg

SEQ ID NO: 3613 - DNA, 20 bp, Artificial Sequence
  PCR primer oSH7
aacacgtccgtcctagaact

SEQ ID NO: 3614 - DNA, 20 bp, Artificial Sequence
  PCR primer oSH8
acttggttacgctcaacact

SEQ ID NO: 3615 - DNA, 82 bp, Artificial Sequence
  PCR primer SAH24
ttcaggttggaccggtgccaccatggccccaaagaagaagcggaaggtcagccaagagatcaagagaatcaacaagatcaga

SEQ ID NO: 3616 - DNA, 28 bp, Artificial Sequence
  PCR primer SAH25
ttttggactagtcacggcgggcttccag

SEQ ID NO: 3617 - DNA, 37 bp, Artificial Sequence
  PCR primer oIC539
atggccccaaagaagaagcggaaggtctctagacaag

SEQ ID NO: 3618 - DNA, 32 bp, Artificial Sequence
  PCR primer oIC540
tacctttctcttcttttttggactagtcacgg

SEQ ID NO: 3619 - DNA, 40 bp, Artificial Sequence
  PCR1 Fwd primer
  misc_feature (34)..(40): n is any nucleotide
acactctttccctacacgacgctcttccgatctnnnnnnn

SEQ ID NO: 3620 - DNA, 34 bp, Artificial Sequence
  PCR2 Rvs primer
gtgactggagttcagacgtgtgctcttccgatct

SEQ ID NO: 3621 - DNA, 52 bp, Artificial Sequence
  PCR2 Fwd primer
aatgatacggcgaccaccgagatctacactctttccctacacgacgctcttc

SEQ ID NO: 3622 - DNA, 64 bp, Artificial Sequence
  PCR2 Rvs v1 001 primer
caagcagaagacggcatacgagatcgtgatgtgactggagttcagacgtgtgctcttccgatct

SEQ ID NO: 3623 - DNA, 168 bp, Artificial Sequence
  Planctomyces reference guide scaffold from the plasmid backbone
tgacagctagctcagtcctaggtataatactagttactggcgcttttatctcattactttgagagccatcaccagcgactatgtcgtatgggtaaagcgcttatttatcggagagaaatccgataaataagaagcatcaaagctggagttgtcccaattcttctagag

SEQ ID NO: 3624 - RNA, 20 nt, Artificial Sequence
  spacer 4.76
uguggucgggguagcggcug

SEQ ID NO: 3625 - RNA, 20 nt, Artificial Sequence
  spacer 4.77
ucaaguccgccaugcccgaa

SEQ ID NO: 3626 - RNA, 20 nt, Artificial Sequence
  spacer 8.2
auguucaugaguuuggagau

SEQ ID NO: 3627 - RNA, 20 nt, Artificial Sequence
  spacer 8.4
ucgccauaacucgcuaggcc

SEQ ID NO: 3628 - DNA, 20 bp, Artificial Sequence
  spacer 11.13
cagcattcttgggtgggagc

SEQ ID NO: 3629 - DNA, 20 bp, Artificial Sequence
  spacer 11.14
tgggtgggagcagccacggg

SEQ ID NO: 3630 - DNA, 20 bp, Artificial Sequence
  spacer 11.15
tggctgtggcccttgtggct

SEQ ID NO: 3631 - DNA, 20 bp, Artificial Sequence
  spacer 11.16
gtgccattcatggctgtggc

SEQ ID NO: 3632 - DNA, 20 bp, Artificial Sequence
  spacer 11.17
acgtgcccttctccaatgcg

SEQ ID NO: 3633 - DNA, 20 bp, Artificial Sequence
  spacer 11.18
ccaatgcgacgggtgtggta

SEQ ID NO: 3634 - DNA, 20 bp, Artificial Sequence
  spacer 11.19
agtacccacagtactacctg

SEQ ID NO: 3635 - DNA, 20 bp, Artificial Sequence
  spacer 11.2
ccatgctggccgcctacatg

SEQ ID NO: 3636 - DNA, 20 bp, Artificial Sequence
  spacer 11.21
gctgatcgtgctgggcttcc

SEQ ID NO: 3637 - DNA, 20 bp, Artificial Sequence
  spacer 11.22
ccatcaacttcctcacgctc

SEQ ID NO: 3638 - DNA, 20 bp, Artificial Sequence
  spacer 11.23
tcacgctctacgtcaccgtc

SEQ ID NO: 3639 - DNA, 20 bp, Artificial Sequence
  spacer 11.24
tgtgctggacggtgacgtag

SEQ ID NO: 3640 - DNA, 20 bp, Artificial Sequence
  spacer 11.25
tggtcctaggtggcttcacc

SEQ ID NO: 3641 - DNA, 20 bp, Artificial Sequence
  spacer 11.26
ccagcaccctctacacctct

SEQ ID NO: 3642 - DNA, 20 bp, Artificial Sequence
  spacer 11.27
tcttcgggcccacaggatgc

SEQ ID NO: 3643 - DNA, 20 bp, Artificial Sequence
  spacer 11.28
ggcccacaggatgcaatttg

SEQ ID NO: 3644 - DNA, 20 bp, Artificial Sequence
  spacer 11.29
ttgccaccctgggcggtatg

SEQ ID NO: 3645 - DNA, 20 bp, Artificial Sequence
  spacer 11.1
aaggggctgcgtaccacacc

SEQ ID NO: 3646 - DNA, 109 bp, Artificial Sequence
  174 guide and spacer 11.13
actggcgcttttatctgattactttgagagccatcaccagcgactatgtcgtagtgggtaaagctccctcttcggagggagcatcaaagcagcattcttgggtgggagc

SEQ ID NO: 3647 - DNA, 109 bp, Artificial Sequence
  174 guide and spacer 11.14
actggcgcttttatctgattactttgagagccatcaccagcgactatgtcgtagtgggtaaagctccctcttcggagggagcatcaaagtgggtgggagcagccacggg

SEQ ID NO: 3648 - DNA, 109 bp, Artificial Sequence
  174 guide and spacer 11.15
actggcgcttttatctgattactttgagagccatcaccagcgactatgtcgtagtgggtaaagctccctcttcggagggagcatcaaagtggctgtggcccttgtggct

SEQ ID NO: 3649 - DNA, 109 bp, Artificial Sequence
  174 guide and spacer 11.16
actggcgcttttatctgattactttgagagccatcaccagcgactatgtcgtagtgggtaaagctccctcttcggagggagcatcaaaggtgccattcatggctgtggc

SEQ ID NO: 3650 - DNA, 109 bp, Artificial Sequence
  174 guide and spacer 11.17
actggcgcttttatctgattactttgagagccatcaccagcgactatgtcgtagtgggtaaagctccctcttcggagggagcatcaaagacgtgcccttctccaatgcg

SEQ ID NO: 3651 - DNA, 109 bp, Artificial Sequence
  174 guide and spacer 11.18
actggcgcttttatctgattactttgagagccatcaccagcgactatgtcgtagtgggtaaagctccctcttcggagggagcatcaaagccaatgcgacgggtgtggta

SEQ ID NO: 3652 - DNA, 109 bp, Artificial Sequence
  174 guide and spacer 11.19
actggcgcttttatctgattactttgagagccatcaccagcgactatgtcgtagtgggtaaagctccctcttcggagggagcatcaaagagtacccacagtactacctg

SEQ ID NO: 3653 - DNA, 109 bp, Artificial Sequence
  174 guide and spacer 11.2
actggcgcttttatctgattactttgagagccatcaccagcgactatgtcgtagtgggtaaagctccctcttcggagggagcatcaaagccatgctggccgcctacatg

SEQ ID NO: 3654 - DNA, 109 bp, Artificial Sequence
  174 guide and spacer 11.21
actggcgcttttatctgattactttgagagccatcaccagcgactatgtcgtagtgggtaaagctccctcttcggagggagcatcaaaggctgatcgtgctgggcttcc

SEQ ID NO: 3655 - DNA, 109 bp, Artificial Sequence
  174 guide and spacer 11.22
actggcgcttttatctgattactttgagagccatcaccagcgactatgtcgtagtgggtaaagctccctcttcggagggagcatcaaagccatcaacttcctcacgctc

SEQ ID NO: 3656 - DNA, 109 bp, Artificial Sequence
  174 guide and spacer 11.23
actggcgcttttatctgattactttgagagccatcaccagcgactatgtcgtagtgggtaaagctccctcttcggagggagcatcaaagtcacgctctacgtcaccgtc

SEQ ID NO: 3657 - DNA, 109 bp, Artificial Sequence
  174 guide and spacer 11.24
actggcgcttttatctgattactttgagagccatcaccagcgactatgtcgtagtgggtaaagctccctcttcggagggagcatcaaagtgtgctggacggtgacgtag

SEQ ID NO: 3658 - DNA, 109 bp, Artificial Sequence
  174 guide and spacer 11.25
actggcgcttttatctgattactttgagagccatcaccagcgactatgtcgtagtgggtaaagctccctcttcggagggagcatcaaagtggtcctaggtggcttcacc

SEQ ID NO: 3659 - DNA, 109 bp, Artificial Sequence
  174 guide and spacer 11.26
actggcgcttttatctgattactttgagagccatcaccagcgactatgtcgtagtgggtaaagctccctcttcggagggagcatcaaagccagcaccctctacacctct

SEQ ID NO: 3660 - DNA, 109 bp, Artificial Sequence
  174 guide and spacer 11.27
actggcgcttttatctgattactttgagagccatcaccagcgactatgtcgtagtgggtaaagctccctcttcggagggagcatcaaagtcttcgggcccacaggatgc

SEQ ID NO: 3661 - DNA, 109 bp, Artificial Sequence
  174 guide and spacer 11.28
actggcgcttttatctgattactttgagagccatcaccagcgactatgtcgtagtgggtaaagctccctcttcggagggagcatcaaagggcccacaggatgcaatttg

SEQ ID NO: 3662 - DNA, 109 bp, Artificial Sequence
  174 guide and spacer 11.29
actggcgcttttatctgattactttgagagccatcaccagcgactatgtcgtagtgggtaaagctccctcttcggagggagcatcaaagttgccaccctgggcggtatg

SEQ ID NO: 3663 - DNA, 109 bp, Artificial Sequence
  174 guide and spacer 11.1
actggcgcttttatctgattactttgagagccatcaccagcgactatgtcgtagtgggtaaagctccctcttcggagggagcatcaaagaaggggctgcgtaccacacc

SEQ ID NO: 3664 - protein, 6 aa, Artificial Sequence
  DME variant alteration
VSSKDL

SEQ ID NO: 3665 - protein, 6 aa, Artificial Sequence
  DME variant reference
GSPGIK

SEQ ID NO: 3666 - protein, 11 aa, Artificial Sequence
  DME variant alteration
VSSKDLQASNK

SEQ ID NO: 3667 - protein, 7 aa, Artificial Sequence
  DME variant alteration
VSSKDLQ

SEQ ID NO: 3668 - protein, 4 aa, Artificial Sequence
  DME variant reference
GSPG

SEQ ID NO: 3669 - protein, 4 aa, Artificial Sequence
  DME variant alteration
VSSK

SEQ ID NO: 3670 - protein, 10 aa, Artificial Sequence
  DME variant alteration
VSSKDLQASN

SEQ ID NO: 3671 - protein, 8 aa, Artificial Sequence
  DME variant alteration
VSSKDLQA

SEQ ID NO: 3672 - protein, 6 aa, Artificial Sequence
  DME variant reference
GSPGIK

SEQ ID NO: 3673 - protein, 5 aa, Artificial Sequence
  DME variant alteration
VSSKD

SEQ ID NO: 3674 - protein, 5 aa, Artificial Sequence
  DME variant reference
GSPGI

SEQ ID NO: 3675 - protein, 9 aa, Artificial Sequence
  DME variant alteration
VSSKDLQAS

SEQ ID NO: 3676 - protein, 6 aa, Artificial Sequence
  DME variant alteration
IKRINK

SEQ ID NO: 3677 - protein, 7 aa, Artificial Sequence
  DME variant alteration
RRTRQDE

SEQ ID NO: 3678 - protein, 5 aa, Artificial Sequence
  DME variant alteration
VSSKE

SEQ ID NO: 3679 - protein, 7 aa, Artificial Sequence
  DME variant alteration
EGQITYY

SEQ ID NO: 3680 - protein, 6 aa, Artificial Sequence
  DME variant alteration
LSRFKD

SEQ ID NO: 3681 - protein, 6 aa, Artificial Sequence
  DME variant alteration
KKHGED

SEQ ID NO: 3682 - protein, 4 aa, Artificial Sequence
  DME variant alteration
EGQI

SEQ ID NO: 3683 - protein, 5 aa, Artificial Sequence
  DME variant alteration
SKTYL

SEQ ID NO: 3684 - protein, 8 aa, Artificial Sequence
  DME variant alteration
VSSKDLRA

SEQ ID NO: 3685 - protein, 5 aa, Artificial Sequence
  DME variant alteration
PTHIL

SEQ ID NO: 3686 - protein, 5 aa, Artificial Sequence
  DME variant alteration
SLLKK

SEQ ID NO: 3687 - protein, 6 aa, Artificial Sequence
  DME variant alteration
QGREFI

SEQ ID NO: 3688 - protein, 6 aa, Artificial Sequence
  DME variant alteration
ETHADE

SEQ ID NO: 3689 - protein, 7 aa, Artificial Sequence
  DME variant alteration
ADDMVRN

SEQ ID NO: 3690 - protein, 6 aa, Artificial Sequence
  DME variant alteration
EGQITY

SEQ ID NO: 3691 - protein, 7 aa, Artificial Sequence
  DME variant alteration
VSSKDLR

SEQ ID NO: 3692 - protein, 8 aa, Artificial Sequence
  DME variant alteration
GQRALDFY

SEQ ID NO: 3693 - protein, 6 aa, Artificial Sequence
  DME variant alteration
RRTRQD

SEQ ID NO: 3694 - protein, 5 aa, Artificial Sequence
  DME variant alteration
ALLPY

SEQ ID NO: 3695 - protein, 4 aa, Artificial Sequence
  DME variant alteration
GYSR

SEQ ID NO: 3696 - protein, 4 aa, Artificial Sequence
  DME variant alteration
DRKK

SEQ ID NO: 3697 - protein, 5 aa, Artificial Sequence
  DME variant alteration
RCNVS

SEQ ID NO: 3698 - protein, 5 aa, Artificial Sequence
  DME variant reference
RCELK

SEQ ID NO: 3699 - protein, 5 aa, Artificial Sequence
  DME variant alteration
SFSSH

SEQ ID NO: 3700 - protein, 4 aa, Artificial Sequence
  DME variant alteration
LNLY

SEQ ID NO: 3701 - protein, 5 aa, Artificial Sequence
  DME variant alteration
VKDLS

SEQ ID NO: 3702 - protein, 4 aa, Artificial Sequence
  DME variant alteration
RCNV

SEQ ID NO: 3703 - protein, 8 aa, Artificial Sequence
  DME variant alteration
RCNVSEHE

SEQ ID NO: 3704 - protein, 4 aa, Artificial Sequence
  DME variant alteration
RRTR

SEQ ID NO: 3705 - protein, 5 aa, Artificial Sequence
  DME variant alteration
QAALN

SEQ ID NO: 3706 - protein, 7 aa, Artificial Sequence
  DME variant alteration
VSSKDLE

SEQ ID NO: 3707 - protein, 7 aa, Artificial Sequence
  DME variant alteration
TLPPQPH

SEQ ID NO: 3708 - protein, 6 aa, Artificial Sequence
  DME variant alteration
SLLKKR

SEQ ID NO: 3709 - protein, 5 aa, Artificial Sequence
  DME variant alteration
ANRFY

SEQ ID NO: 3710 - protein, 5 aa, Artificial Sequence
  DME variant alteration
LANGR

SEQ ID NO: 3711 - protein, 4 aa, Artificial Sequence
  DME variant alteration
DACM

SEQ ID NO: 3712 - protein, 4 aa, Artificial Sequence
  DME variant alteration
EVLD

SEQ ID NO: 3713 - protein, 6 aa, Artificial Sequence
  DME variant alteration
RCNVSE

SEQ ID NO: 3714 - protein, 6 aa, Artificial Sequence
  DME variant alteration
VSSKDQ

SEQ ID NO: 3715 - protein, 6 aa, Artificial Sequence
  DME variant alteration
GGNSCA

SEQ ID NO: 3716 - protein, 4 aa, Artificial Sequence
  DME variant alteration
RFYT

SEQ ID NO: 3717 - protein, 7 aa, Artificial Sequence
  DME variant alteration
ETWQSFY

SEQ ID NO: 3718 - protein, 8 aa, Artificial Sequence
  DME variant alteration
TDKRAFVE

SEQ ID NO: 3719 - protein, 6 aa, Artificial Sequence
  DME variant alteration
NRYKRQ

SEQ ID NO: 3720 - protein, 8 aa, Artificial Sequence
  DME variant alteration
GVKKLNLY

SEQ ID NO: 3721 - protein, 6 aa, Artificial Sequence
  DME variant alteration
PTHILR

SEQ ID NO: 3722 - protein, 7 aa, Artificial Sequence
  DME variant alteration
GNTDKRA

SEQ ID NO: 3723 - protein, 5 aa, Artificial Sequence
  DME variant alteration
KGKPH

SEQ ID NO: 3724 - protein, 8 aa, Artificial Sequence
  DME variant alteration
GGNSCASG

SEQ ID NO: 3725 - protein, 7 aa, Artificial Sequence
  DME variant alteration
GKPHTNY

SEQ ID NO: 3726 - protein, 6 aa, Artificial Sequence
  DME variant alteration
IFENLS

SEQ ID NO: 3727 - protein, 4 aa, Artificial Sequence
  DME variant alteration
SLLK

SEQ ID NO: 3728 - protein, 5 aa, Artificial Sequence
  DME variant alteration
ETHAA

SEQ ID NO: 3729 - protein, 7 aa, Artificial Sequence
  DME variant alteration
LETGSLK

SEQ ID NO: 3730 - protein, 7 aa, Artificial Sequence
  DME variant alteration
LSRFKDS

SEQ ID NO: 3731 - protein, 5 aa, Artificial Sequence
  DME variant alteration
GKPHT

SEQ ID NO: 3732 - protein, 5 aa, Artificial Sequence
  DME variant alteration
TKYQD

SEQ ID NO: 3733 - protein, 5 aa, Artificial Sequence
  DME variant alteration
NSILD

SEQ ID NO: 3734 - protein, 4 aa, Artificial Sequence
  DME variant alteration
EERR

SEQ ID NO: 3735 - protein, 6 aa, Artificial Sequence
  DME variant alteration
KLNLYL

SEQ ID NO: 3736 - protein, 4 aa, Artificial Sequence
  DME variant alteration
PTHI

SEQ ID NO: 3737 - protein, 5 aa, Artificial Sequence
  DME variant alteration
ETWQS

SEQ ID NO: 3738 - protein, 5 aa, Artificial Sequence
  DME variant alteration
SKQYN

SEQ ID NO: 3739 - protein, 7 aa, Artificial Sequence
  DME variant alteration
NPTHILR

SEQ ID NO: 3740 - protein, 6 aa, Artificial Sequence
  DME variant alteration
DLSVEL

SEQ ID NO: 3741 - protein, 4 aa, Artificial Sequence
  DME variant alteration
SNIK

SEQ ID NO: 3742 - protein, 8 aa, Artificial Sequence
  DME variant reference
KKHGEDWG

SEQ ID NO: 3743 - protein, 8 aa, Artificial Sequence
  DME variant alteration
RSTARTGA

SEQ ID NO: 3744 - protein, 7 aa, Artificial Sequence
  DME variant alteration
ERIDKKV

SEQ ID NO: 3745 - protein, 6 aa, Artificial Sequence
  DME variant alteration
VCNVKK

SEQ ID NO: 3746 - protein, 7 aa, Artificial Sequence
  DME variant alteration
ERREVLD

SEQ ID NO: 3747 - protein, 6 aa, Artificial Sequence
  DME variant alteration
QKDGVK

SEQ ID NO: 3748 - protein, 4 aa, Artificial Sequence
  DME variant alteration
LSEE

SEQ ID NO: 3749 - protein, 4 aa, Artificial Sequence
  DME variant alteration
VIEK

SEQ ID NO: 3750 - protein, 9 aa, Artificial Sequence
  DME variant alteration
FETHAAEQA

SEQ ID NO: 3751 - protein, 6 aa, Artificial Sequence
  DME variant alteration
QIGGNS

SEQ ID NO: 3752 - protein, 4 aa, Artificial Sequence
  DME variant alteration
KPAV

SEQ ID NO: 3753 - protein, 5 aa, Artificial Sequence
  DME variant alteration
DACMG

SEQ ID NO: 3754 - protein, 6 aa, Artificial Sequence
  DME variant alteration
DWGKVY

SEQ ID NO: 3755 - protein, 4 aa, Artificial Sequence
  DME variant alteration
GKRQ

SEQ ID NO: 3756 - protein, 6 aa, Artificial Sequence
  DME variant alteration
ANLKDI

SEQ ID NO: 3757 - protein, 8 aa, Artificial Sequence
  DME variant alteration
SKTLAQYT

SEQ ID NO: 3758 - protein, 4 aa, Artificial Sequence
  DME variant alteration
TFER

SEQ ID NO: 3759 - protein, 5 aa, Artificial Sequence
  DME variant alteration
LGNPT

SEQ ID NO: 3760 - protein, 4 aa, Artificial Sequence
  DME variant alteration
VCLN

SEQ ID NO: 3761 - protein, 8 aa, Artificial Sequence
  DME variant alteration
VVKDLSVE

SEQ ID NO: 3762 - protein, 4 aa, Artificial Sequence
  DME variant alteration
GRII

SEQ ID NO: 3763 - protein, 4 aa, Artificial Sequence
  DME variant alteration
NSSL

SEQ ID NO: 3764 - protein, 6 aa, Artificial Sequence
  DME variant alteration
THAAEQ

SEQ ID NO: 3765 - protein, 8 aa, Artificial Sequence
  DME variant alteration
LANGRVIE

SEQ ID NO: 3766 - protein, 4 aa, Artificial Sequence
  DME variant alteration
TTIN

SEQ ID NO: 3767 - protein, 7 aa, Artificial Sequence
  DME variant alteration
AKEVEQR

SEQ ID NO: 3768 - protein, 4 aa, Artificial Sequence
  DME variant alteration
KLQK

SEQ ID NO: 3769 - protein, 7 aa, Artificial Sequence
  DME variant alteration
THAAEQA

SEQ ID NO: 3770 - protein, 6 aa, Artificial Sequence
  DME variant alteration
IQAAKE

SEQ ID NO: 3771 - protein, 7 aa, Artificial Sequence
  DME variant alteration
QRALDFY

SEQ ID NO: 3772 - protein, 6 aa, Artificial Sequence
  DME variant alteration
PEANDE

SEQ ID NO: 3773 - protein, 6 aa, Artificial Sequence
  DME variant alteration
ETHAAE

SEQ ID NO: 3774 - protein, 6 aa, Artificial Sequence
  DME variant alteration
RSWLFL

SEQ ID NO: 3775 - protein, 6 aa, Artificial Sequence
  DME variant reference
RSWLFL

SEQ ID NO: 3776 - protein, 7 aa, Artificial Sequence
  DME variant alteration
AEQAALN

SEQ ID NO: 3777 - protein, 8 aa, Artificial Sequence
  DME variant alteration
GKPHTNYF

SEQ ID NO: 3778 - protein, 5 aa, Artificial Sequence
  DME variant alteration
VKKLN

SEQ ID NO: 3779 - protein, 4 aa, Artificial Sequence
  DME variant alteration
ADDM

SEQ ID NO: 3780 - protein, 7 aa, Artificial Sequence
  DME variant alteration
VSSKDLK

SEQ ID NO: 3781 - protein, 4 aa, Artificial Sequence
  DME variant alteration
TKYQ

SEQ ID NO: 3782 - protein, 7 aa, Artificial Sequence
  DME variant alteration
SHRPVQE

SEQ ID NO: 3783 - protein, 5 aa, Artificial Sequence
  DME variant alteration
ALDFY

SEQ ID NO: 3784 - protein, 6 aa, Artificial Sequence
  DME variant alteration
LTAKLA

SEQ ID NO: 3785 - protein, 7 aa, Artificial Sequence
  DME variant alteration
KTLAQYT

SEQ ID NO: 3786 - protein, 7 aa, Artificial Sequence
  DME variant alteration
NRFYTVI

SEQ ID NO: 3787 - protein, 4 aa, Artificial Sequence
  DME variant alteration
KPMN

SEQ ID NO: 3788 - protein, 5 aa, Artificial Sequence
  DME variant alteration
TNYFG

SEQ ID NO: 3789 - protein, 7 aa, Artificial Sequence
  DME variant alteration
SLGKFGQ

SEQ ID NO: 3790 - protein, 4 aa, Artificial Sequence
  DME variant alteration
QTNK

SEQ ID NO: 3791 - protein, 4 aa, Artificial Sequence
  DME variant alteration
IPAV

SEQ ID NO: 3792 - protein, 7 aa, Artificial Sequence
  DME variant alteration
EVLDSSN

SEQ ID NO: 3793 - protein, 7 aa, Artificial Sequence
  DME variant alteration
KKVEGLS

SEQ ID NO: 3794 - protein, 7 aa, Artificial Sequence
  DME variant alteration
NVSEHER

SEQ ID NO: 3795 - protein, 5 aa, Artificial Sequence
  DME variant alteration
PSKTY

SEQ ID NO: 3796 - protein, 7 aa, Artificial Sequence
  DME variant alteration
ADKDEFC

SEQ ID NO: 3797 - protein, 4 aa, Artificial Sequence
  DME variant alteration
VEGQ

SEQ ID NO: 3798 - protein, 5 aa, Artificial Sequence
  DME variant alteration
ADDMV

SEQ ID NO: 3799 - protein, 6 aa, Artificial Sequence
  DME variant alteration
YYAVTQ

SEQ ID NO: 3800 - protein, 5 aa, Artificial Sequence
  DME variant reference
ALSDA

SEQ ID NO: 3801 - protein, 4 aa, Artificial Sequence
  DME variant reference
AYEG

SEQ ID NO: 3802 - protein, 4 aa, Artificial Sequence
  DME variant reference
DLLY

SEQ ID NO: 3803 - protein, 4 aa, Artificial Sequence
  DME variant reference
EAFE

SEQ ID NO: 3804 - protein, 10 aa, Artificial Sequence
  DME variant reference
EAWERIDKKV

SEQ ID NO: 3805 - protein, 4 aa, Artificial Sequence
  DME variant reference
ELDR

SEQ ID NO: 3806 - protein, 7 aa, Artificial Sequence
  DME variant reference
FMAERQY

SEQ ID NO: 3807 - protein, 4 aa, Artificial Sequence
  DME variant reference
FVAL

SEQ ID NO: 3808 - protein, 4 aa, Artificial Sequence
  DME variant reference
GCPL

SEQ ID NO: 3809 - protein, 7 aa, Artificial Sequence
  DME variant reference
GGKLRFK

SEQ ID NO: 3810 - protein, 11 aa, Artificial Sequence
  DME variant reference
GKFGQRALDFY

SEQ ID NO: 3811 - protein, 4 aa, Artificial Sequence
  DME variant reference
GNPT

SEQ ID NO: 3812 - protein, 10 aa, Artificial Sequence
  DME variant reference
HTNYFGRCNV

SEQ ID NO: 3813 - protein, 4 aa, Artificial Sequence
  DME variant reference
ILRI

SEQ ID NO: 3814 - protein, 7 aa, Artificial Sequence
  DME variant reference
KDSNTKK

SEQ ID NO: 3815 - protein, 5 aa, Artificial Sequence
  DME variant reference
KGFPS

SEQ ID NO: 3816 - protein, 5 aa, Artificial Sequence
  DME variant reference
KKHGE

SEQ ID NO: 3817 - protein, 6 aa, Artificial Sequence
  DME variant reference
KPLQRL

SEQ ID NO: 3818 - protein, 6 aa, Artificial Sequence
  DME variant reference
KQYNCA

SEQ ID NO: 3819 - protein, 5 aa, Artificial Sequence
  DME variant reference
KSGEI

SEQ ID NO: 3820 - protein, 4 aa, Artificial Sequence
  DME variant reference
KWYG

SEQ ID NO: 3821 - protein, 5 aa, Artificial Sequence
  DME variant reference
KWYGD

SEQ ID NO: 3822 - protein, 6 aa, Artificial Sequence
  DME variant reference
KWYGDL

SEQ ID NO: 3823 - protein, 7 aa, Artificial Sequence
  DME variant reference
LDFYSIH

SEQ ID NO: 3824 - protein, 8 aa, Artificial Sequence
  DME variant reference
LDFYSIHV

SEQ ID NO: 3825 - protein, 5 aa, Artificial Sequence
  DME variant reference
LEQIG

SEQ ID NO: 3826 - protein, 6 aa, Artificial Sequence
  DME variant reference
LEQIGG

SEQ ID NO: 3827 - protein, 6 aa, Artificial Sequence
  DME variant reference
NCGFET

SEQ ID NO: 3828 - protein, 4 aa, Artificial Sequence
  DME variant reference
NLYL

SEQ ID NO: 3829 - protein, 6 aa, Artificial Sequence
  DME variant reference
PKITLP

SEQ ID NO: 3830 - protein, 6 aa, Artificial Sequence
  DME variant reference
RIDKKV

SEQ ID NO: 3831 - protein, 6 aa, Artificial Sequence
  DME variant reference
SEDAQS

SEQ ID NO: 3832 - protein, 4 aa, Artificial Sequence
  DME variant reference
TGWM

SEQ ID NO: 3833 - protein, 4 aa, Artificial Sequence
  DME variant reference
TING

SEQ ID NO: 3834 - protein, 4 aa, Artificial Sequence
  DME variant reference
TLYN

SEQ ID NO: 3835 - protein, 8 aa, Artificial Sequence
  DME variant reference
TLYNRRTR

SEQ ID NO: 3836 - protein, 5 aa, Artificial Sequence
  DME variant reference
VAQIV

SEQ ID NO: 3837 - protein, 7 aa, Artificial Sequence
  DME variant reference
VKDSNTK

SEQ ID NO: 3838 - protein, 4 aa, Artificial Sequence
  DME variant reference
VTYS

SEQ ID NO: 3839 - protein, 10 aa, Artificial Sequence
  DME variant reference
VTYSLGKFGQ

SEQ ID NO: 3840 - protein, 7 aa, Artificial Sequence
  DME variant reference
VYDEAWE

SEQ ID NO: 3841 - protein, 4 aa, Artificial Sequence
  DME variant alteration
AAEQ

SEQ ID NO: 3842 - protein, 5 aa, Artificial Sequence
  DME variant alteration
AAEQA

SEQ ID NO: 3843 - protein, 8 aa, Artificial Sequence
  DME variant alteration
AAKEVEQR

SEQ ID NO: 3844 - protein, 7 aa, Artificial Sequence
  DME variant alteration
AASCGSR

SEQ ID NO: 3845 - protein, 6 aa, Artificial Sequence
  DME variant alteration
ADDMVR

SEQ ID NO: 3846 - protein, 4 aa, Artificial Sequence
  DME variant alteration
ADYD

SEQ ID NO: 3847 - protein, 5 aa, Artificial Sequence
  DME variant alteration
AERQY

SEQ ID NO: 3848 - protein, 8 aa, Artificial Sequence
  DME variant alteration
AFEANRFY

SEQ ID NO: 3849 - protein, 4 aa, Artificial Sequence
  DME variant alteration
AFGK

SEQ ID NO: 3850 - protein, 7 aa, Artificial Sequence
  DME variant alteration
AFGKRQG

SEQ ID NO: 3851 - protein, 6 aa, Artificial Sequence
  DME variant alteration
AGYKRQ

SEQ ID NO: 3852 - protein, 4 aa, Artificial Sequence
  DME variant alteration
AKNL

SEQ ID NO: 3853 - protein, 8 aa, Artificial Sequence
  DME variant alteration
AKPLQRLK

SEQ ID NO: 3854 - protein, 4 aa, Artificial Sequence
  DME variant alteration
ALLP

SEQ ID NO: 3855 - protein, 4 aa, Artificial Sequence
  DME variant alteration
ALNI

SEQ ID NO: 3856 - protein, 7 aa, Artificial Sequence
  DME variant alteration
ALSDACM

SEQ ID NO: 3857 - protein, 4 aa, Artificial Sequence
  DME variant alteration
ALTD

SEQ ID NO: 3858 - protein, 6 aa, Artificial Sequence
  DME variant alteration
ALTDPE

SEQ ID NO: 3859 - protein, 7 aa, Artificial Sequence
  DME variant alteration
ALTDWLR

SEQ ID NO: 3860 - protein, 4 aa, Artificial Sequence
  DME variant alteration
ANLS

SEQ ID NO: 3861 - protein, 6 aa, Artificial Sequence
  DME variant alteration
AQIVIW

SEQ ID NO: 3862 - protein, 4 aa, Artificial Sequence
  DME variant alteration
AQSK

SEQ ID NO: 3863 - protein, 6 aa, Artificial Sequence
  DME variant alteration
ASGPVG

SEQ ID NO: 3864 - protein, 11 aa, Artificial Sequence
  DME variant alteration
ASSDREPWTST

SEQ ID NO: 3865 - protein, 4 aa, Artificial Sequence
  DME variant alteration
ASSK

SEQ ID NO: 3866 - protein, 10 aa, Artificial Sequence
  DME variant alteration
ASSKDLQASN

SEQ ID NO: 3867 - protein, 4 aa, Artificial Sequence
  DME variant alteration
ATLH

SEQ ID NO: 3868 - protein, 4 aa, Artificial Sequence
  DME variant alteration
AVTQ

SEQ ID NO: 3869 - protein, 5 aa, Artificial Sequence
  DME variant alteration
AVTQD

SEQ ID NO: 3870 - protein, 7 aa, Artificial Sequence
  DME variant alteration
AWERIDK

SEQ ID NO: 3871 - protein, 5 aa, Artificial Sequence
  DME variant alteration
AYNNV

SEQ ID NO: 3872 - protein, 5 aa, Artificial Sequence
  DME variant alteration
CNVSE

SEQ ID NO: 3873 - protein, 6 aa, Artificial Sequence
  DME variant alteration
CTMRPG

SEQ ID NO: 3874 - protein, 7 aa, Artificial Sequence
  DME variant alteration
DACMGAV

SEQ ID NO: 3875 - protein, 5 aa, Artificial Sequence
  DME variant alteration
DAQSK

SEQ ID NO: 3876 - protein, 4 aa, Artificial Sequence
  DME variant alteration
DDMV

SEQ ID NO: 3877 - protein, 7 aa, Artificial Sequence
  DME variant alteration
DDPNLII

SEQ ID NO: 3878 - protein, 4 aa, Artificial Sequence
  DME variant alteration
DEAW

SEQ ID NO: 3879 - protein, 5 aa, Artificial Sequence
  DME variant alteration
DEAWE

SEQ ID NO: 3880 - protein, 8 aa, Artificial Sequence
  DME variant alteration
DEAWERID

SEQ ID NO: 3881 - protein, 5 aa, Artificial Sequence
  DME variant alteration
DEFCR

SEQ ID NO: 3882 - protein, 7 aa, Artificial Sequence
  DME variant alteration
DEFCRCE

SEQ ID NO: 3883 - protein, 4 aa, Artificial Sequence
  DME variant alteration
DELV

SEQ ID NO: 3884 - protein, 5 aa, Artificial Sequence
  DME variant alteration
DFYSI

SEQ ID NO: 3885 - protein, 6 aa, Artificial Sequence
  DME variant alteration
DFYSIH

SEQ ID NO: 3886 - protein, 5 aa, Artificial Sequence
  DME variant alteration
DHSRD

SEQ ID NO: 3887 - protein, 4 aa, Artificial Sequence
  DME variant alteration
DISG

SEQ ID NO: 3888 - protein, 6 aa, Artificial Sequence
  DME variant alteration
DISGFS

SEQ ID NO: 3889 - protein, 4 aa, Artificial Sequence
  DME variant alteration
DISS

SEQ ID NO: 3890 - protein, 4 aa, Artificial Sequence
  DME variant alteration
DKRA

SEQ ID NO: 3891 - protein, 6 aa, Artificial Sequence
  DME variant alteration
DKRAFV

SEQ ID NO: 3892 - protein, 5 aa, Artificial Sequence
  DME variant alteration
DLLLH

SEQ ID NO: 3893 - protein, 6 aa, Artificial Sequence
  DME variant alteration
DLLLHL

SEQ ID NO: 3894 - protein, 4 aa, Artificial Sequence
  DME variant alteration
DLLS

SEQ ID NO: 3895 - protein, 6 aa, Artificial Sequence
  DME variant alteration
DLLSLE

SEQ ID NO: 3896 - protein, 4 aa, Artificial Sequence
  DME variant alteration
DMVC

SEQ ID NO: 3897 - protein, 4 aa, Artificial Sequence
  DME variant alteration
DNQV

SEQ ID NO: 3898 - protein, 5 aa, Artificial Sequence
  DME variant alteration
DNQVG

SEQ ID NO: 3899 - protein, 7 aa, Artificial Sequence
  DME variant alteration
DYDRVLE

SEQ ID NO: 3900 - protein, 6 aa, Artificial Sequence
  DME variant alteration
EAAVQA

SEQ ID NO: 3901 - protein, 8 aa, Artificial Sequence
  DME variant alteration
EADKDEFC

SEQ ID NO: 3902 - protein, 7 aa, Artificial Sequence
  DME variant alteration
EAENSIL

SEQ ID NO: 3903 - protein, 5 aa, Artificial Sequence
  DME variant alteration
EAGCS

SEQ ID NO: 3904 - protein, 5 aa, Artificial Sequence
  DME variant alteration
EANDE

SEQ ID NO: 3905 - protein, 4 aa, Artificial Sequence
  DME variant alteration
EAWE

SEQ ID NO: 3906 - protein, 5 aa, Artificial Sequence
  DME variant alteration
EAWER

SEQ ID NO: 3907 - protein, 6 aa, Artificial Sequence
  DME variant alteration
EEERRS

SEQ ID NO: 3908 - protein, 5 aa, Artificial Sequence
  DME variant alteration
EERRS

SEQ ID NO: 3909 - protein, 5 aa, Artificial Sequence
  DME variant alteration
EFCRC

SEQ ID NO: 3910 - protein, 4 aa, Artificial Sequence
  DME variant alteration
EGLS

SEQ ID NO: 3911 - protein, 5 aa, Artificial Sequence
  DME variant alteration
EGQIT

SEQ ID NO: 3912 - protein, 8 aa, Artificial Sequence
  DME variant alteration
EGQITYYN

SEQ ID NO: 3913 - protein, 6 aa, Artificial Sequence
  DME variant alteration
EHERLI

SEQ ID NO: 3914 - protein, 5 aa, Artificial Sequence
  DME variant alteration
EKKED

SEQ ID NO: 3915 - protein, 5 aa, Artificial Sequence
  DME variant alteration
EKKHG

SEQ ID NO: 3916 - protein, 4 aa, Artificial Sequence
  DME variant alteration
ERLI

SEQ ID NO: 3917 - protein, 6 aa, Artificial Sequence
  DME variant alteration
ESNHPV

SEQ ID NO: 3918 - protein, 6 aa, Artificial Sequence
  DME variant alteration
ESVNND

SEQ ID NO: 3919 - protein, 4 aa, Artificial Sequence
  DME variant alteration
ETHA

SEQ ID NO: 3920 - protein, 5 aa, Artificial Sequence
  DME variant alteration
EVLDS

SEQ ID NO: 3921 - protein, 5 aa, Artificial Sequence
  DME variant alteration
EVNFN

SEQ ID NO: 3922 - protein, 7 aa, Artificial Sequence
  DME variant alteration
FAIEAEN

SEQ ID NO: 3923 - protein, 5 aa, Artificial Sequence
  DME variant alteration
FERRE

SEQ ID NO: 3924 - protein, 6 aa, Artificial Sequence
  DME variant alteration
FGKRQG

SEQ ID NO: 3925 - protein, 7 aa, Artificial Sequence
  DME variant alteration
FGQRALD

SEQ ID NO: 3926 - protein, 4 aa, Artificial Sequence
  DME variant alteration
FIWN

SEQ ID NO: 3927 - protein, 7 aa, Artificial Sequence
  DME variant alteration
FIWNDLL

SEQ ID NO: 3928 - protein, 7 aa, Artificial Sequence
  DME variant alteration
FPSFPLV

SEQ ID NO: 3929 - protein, 6 aa, Artificial Sequence
  DME variant alteration
FSKQYN

SEQ ID NO: 3930 - protein, 8 aa, Artificial Sequence
  DME variant alteration
FSKQYNCA

SEQ ID NO: 3931 - protein, 4 aa, Artificial Sequence
  DME variant alteration
FSSK

SEQ ID NO: 3932 - protein, 7 aa, Artificial Sequence
  DME variant alteration
FSSKDLQ

SEQ ID NO: 3933 - protein, 11 aa, Artificial Sequence
  DME variant alteration
FSSKDLQASNK

SEQ ID NO: 3934 - protein, 5 aa, Artificial Sequence
  DME variant alteration
FVCLN

SEQ ID NO: 3935 - protein, 5 aa, Artificial Sequence
  DME variant alteration
FYRKK

SEQ ID NO: 3936 - protein, 6 aa, Artificial Sequence
  DME variant alteration
GAVASF

SEQ ID NO: 3937 - protein, 6 aa, Artificial Sequence
  DME variant alteration
GCPLSR

SEQ ID NO: 3938 - protein, 8 aa, Artificial Sequence
  DME variant alteration
GCPLSRFK

SEQ ID NO: 3939 - protein, 6 aa, Artificial Sequence
  DME variant alteration
GDLLLH

SEQ ID NO: 3940 - protein, 4 aa, Artificial Sequence
  DME variant alteration
GDLR

SEQ ID NO: 3941 - protein, 6 aa, Artificial Sequence
  DME variant alteration
GDLRGK

SEQ ID NO: 3942 - protein, 7 aa, Artificial Sequence
  DME variant alteration
GDLRGKP

SEQ ID NO: 3943 - protein, 7 aa, Artificial Sequence
  DME variant alteration
GFSKQYN

SEQ ID NO: 3944 - protein, 7 aa, Artificial Sequence
  DME variant alteration
GKELKVE

SEQ ID NO: 3945 - protein, 5 aa, Artificial Sequence
  DME variant alteration
GKFGQ

SEQ ID NO: 3946 - protein, 6 aa, Artificial Sequence
  DME variant alteration
GKFGQR

SEQ ID NO: 3947 - protein, 6 aa, Artificial Sequence
  DME variant alteration
GKPHTN

SEQ ID NO: 3948 - protein, 9 aa, Artificial Sequence
  DME variant alteration
GKVYDEAWE

SEQ ID NO: 3949 - protein, 6 aa, Artificial Sequence
  DME variant alteration
GLAFPK

SEQ ID NO: 3950 - protein, 7 aa, Artificial Sequence
  DME variant alteration
GLKEADK

SEQ ID NO: 3951 - protein, 5 aa, Artificial Sequence
  DME variant alteration
GLPSK

SEQ ID NO: 3952 - protein, 4 aa, Artificial Sequence
  DME variant alteration
GNTD

SEQ ID NO: 3953 - protein, 5 aa, Artificial Sequence
  DME variant alteration
GNTDK

SEQ ID NO: 3954 - protein, 5 aa, Artificial Sequence
  DME variant alteration
GREFI

SEQ ID NO: 3955 - protein, 6 aa, Artificial Sequence
  DME variant alteration
GREFIW

SEQ ID NO: 3956 - protein, 6 aa, Artificial Sequence
  DME variant alteration
GRSGEA

SEQ ID NO: 3957 - protein, 7 aa, Artificial Sequence
  DME variant alteration
GRSGEAL

SEQ ID NO: 3958 - protein, 7 aa, Artificial Sequence
  DME variant alteration
GSLKLAN

SEQ ID NO: 3959 - protein, 5 aa, Artificial Sequence
  DME variant alteration
GYKRQ

SEQ ID NO: 3960 - protein, 5 aa, Artificial Sequence
  DME variant alteration
GYSRK

SEQ ID NO: 3961 - protein, 8 aa, Artificial Sequence
  DME variant alteration
GYSRKYAS

SEQ ID NO: 3962 - protein, 7 aa, Artificial Sequence
  DME variant alteration
HERLILL

SEQ ID NO: 3963 - protein, 5 aa, Artificial Sequence
  DME variant alteration
HIKLE

SEQ ID NO: 3964 - protein, 4 aa, Artificial Sequence
  DME variant alteration
HRPV

SEQ ID NO: 3965 - protein, 4 aa, Artificial Sequence
  DME variant alteration
HTKE

SEQ ID NO: 3966 - protein, 5 aa, Artificial Sequence
  DME variant alteration
HTKEG

SEQ ID NO: 3967 - protein, 7 aa, Artificial Sequence
  DME variant alteration
HTKEGIE

SEQ ID NO: 3968 - protein, 5 aa, Artificial Sequence
  DME variant alteration
IARGE

SEQ ID NO: 3969 - protein, 6 aa, Artificial Sequence
  DME variant alteration
IDRGEN

SEQ ID NO: 3970 - protein, 6 aa, Artificial Sequence
  DME variant alteration
IEAENS

SEQ ID NO: 3971 - protein, 7 aa, Artificial Sequence
  DME variant alteration
IEAENSI

SEQ ID NO: 3972 - protein, 9 aa, Artificial Sequence
  DME variant alteration
IEAENSILD

SEQ ID NO: 3973 - protein, 7 aa, Artificial Sequence
  DME variant alteration
IEKTLYN

SEQ ID NO: 3974 - protein, 6 aa, Artificial Sequence
  DME variant alteration
IFANLS

SEQ ID NO: 3975 - protein, 7 aa, Artificial Sequence
  DME variant alteration
IFANLSR

SEQ ID NO: 3976 - protein, 6 aa, Artificial Sequence
  DME variant alteration
ILEHQK

SEQ ID NO: 3977 - protein, 7 aa, Artificial Sequence
  DME variant alteration
INGKELK

SEQ ID NO: 3978 - protein, 5 aa, Artificial Sequence
  DME variant alteration
INYFK

SEQ ID NO: 3979 - protein, 5 aa, Artificial Sequence
  DME variant alteration
IQAAK

SEQ ID NO: 3980 - protein, 7 aa, Artificial Sequence
  DME variant alteration
ISSKDLQ

SEQ ID NO: 3981 - protein, 4 aa, Artificial Sequence
  DME variant alteration
ITYY

SEQ ID NO: 3982 - protein, 5 aa, Artificial Sequence
  DME variant alteration
ITYYN

SEQ ID NO: 3983 - protein, 4 aa, Artificial Sequence
  DME variant alteration
IWND

SEQ ID NO: 3984 - protein, 6 aa, Artificial Sequence
  DME variant alteration
IWNDLL

SEQ ID NO: 3985 - protein, 5 aa, Artificial Sequence
  DME variant alteration
IWQKD

SEQ ID NO: 3986 - protein, 5 aa, Artificial Sequence
  DME variant alteration
KDSLG

SEQ ID NO: 3987 - protein, 4 aa, Artificial Sequence
  DME variant alteration
KEAD

SEQ ID NO: 3988 - protein, 7 aa, Artificial Sequence
  DME variant alteration
KEADKDE

SEQ ID NO: 3989 - protein, 4 aa, Artificial Sequence
  DME variant alteration
KEDG

SEQ ID NO: 3990 - protein, 6 aa, Artificial Sequence
  DME variant alteration
KEVEQR

SEQ ID NO: 3991 - protein, 7 aa, Artificial Sequence
  DME variant alteration
KGKPHTN

SEQ ID NO: 3992 - protein, 8 aa, Artificial Sequence
  DME variant alteration
KGKPHTNY

SEQ ID NO: 3993 - protein, 5 aa, Artificial Sequence
  DME variant alteration
KHGED

SEQ ID NO: 3994 - protein, 4 aa, Artificial Sequence
  DME variant alteration
KKGK

SEQ ID NO: 3995 - protein, 5 aa, Artificial Sequence
  DME variant alteration
KKGKK

SEQ ID NO: 3996 - protein, 4 aa, Artificial Sequence
  DME variant alteration
KKIK

SEQ ID NO: 3997 - protein, 4 aa, Artificial Sequence
  DME variant alteration
KKLI

SEQ ID NO: 3998 - protein, 6 aa, Artificial Sequence
  DME variant alteration
KKLINE

SEQ ID NO: 3999 - protein, 7 aa, Artificial Sequence
  DME variant alteration
KKLKEVW

SEQ ID NO: 4000 - protein, 4 aa, Artificial Sequence
  DME variant alteration
KKNE

SEQ ID NO: 4001 - protein, 4 aa, Artificial Sequence
  DME variant alteration
KKVE

SEQ ID NO: 4002 - protein, 6 aa, Artificial Sequence
  DME variant alteration
KKYQTN

SEQ ID NO: 4003 - protein, 9 aa, Artificial Sequence
  DME variant alteration
KLKIGRDEA

SEQ ID NO: 4004 - protein, 4 aa, Artificial Sequence
  DME variant alteration
KLKK

SEQ ID NO: 4005 - protein, 4 aa, Artificial Sequence
  DME variant alteration
KLNL

SEQ ID NO: 4006 - protein, 5 aa, Artificial Sequence
  DME variant alteration
KLQKW

SEQ ID NO: 4007 - protein, 4 aa, Artificial Sequence
  DME variant alteration
KLRF

SEQ ID NO: 4008 - protein, 5 aa, Artificial Sequence
  DME variant alteration
KLRFK

SEQ ID NO: 4009 - protein, 5 aa, Artificial Sequence
  DME variant alteration
KNEKR

SEQ ID NO: 4010 - protein, 4 aa, Artificial Sequence
  DME variant alteration
KPEA

SEQ ID NO: 4011 - protein, 4 aa, Artificial Sequence
  DME variant alteration
KPHT

SEQ ID NO: 4012 - protein, 6 aa, Artificial Sequence
  DME variant alteration
KPHTNY

SEQ ID NO: 4013 - protein, 7 aa, Artificial Sequence
  DME variant alteration
KPHTNYF

SEQ ID NO: 4014 - protein, 7 aa, Artificial Sequence
  DME variant alteration
KPMNLIG

SEQ ID NO: 4015 - protein, 4 aa, Artificial Sequence
  DME variant alteration
KQYN

SEQ ID NO: 4016 - protein, 5 aa, Artificial Sequence
  DME variant alteration
KQYNC

SEQ ID NO: 4017 - protein, 4 aa, Artificial Sequence
  DME variant alteration
KRLA

SEQ ID NO: 4018 - protein, 8 aa, Artificial Sequence
  DME variant alteration
KRLANLKD

SEQ ID NO: 4019 - protein, 5 aa, Artificial Sequence
  DME variant alteration
KRQGR

SEQ ID NO: 4020 - protein, 7 aa, Artificial Sequence
  DME variant alteration
KTYLSKT

SEQ ID NO: 4021 - protein, 6 aa, Artificial Sequence
  DME variant alteration
KVEGQI

SEQ ID NO: 4022 - protein, 8 aa, Artificial Sequence
  DME variant alteration
KYQDIILE

SEQ ID NO: 4023 - protein, 6 aa, Artificial Sequence
  DME variant alteration
LAFGKR

SEQ ID NO: 4024 - protein, 7 aa, Artificial Sequence
  DME variant alteration
LAFPKIT

SEQ ID NO: 4025 - protein, 6 aa, Artificial Sequence
  DME variant alteration
LANGRV

SEQ ID NO: 4026 - protein, 6 aa, Artificial Sequence
  DME variant alteration
LANLKD

SEQ ID NO: 4027 - protein, 4 aa, Artificial Sequence
  DME variant alteration
LAQY

SEQ ID NO: 4028 - protein, 4 aa, Artificial Sequence
  DME variant alteration
LAYE

SEQ ID NO: 4029 - protein, 9 aa, Artificial Sequence
  DME variant alteration
LDFYSIHVT

SEQ ID NO: 4030 - protein, 4 aa, Artificial Sequence
  DME variant alteration
LEQI

SEQ ID NO: 4031 - protein, 5 aa, Artificial Sequence
  DME variant alteration
LEQIG

SEQ ID NO: 4032 - protein, 4 aa, Artificial Sequence
  DME variant alteration
LFLR

SEQ ID NO: 4033 - protein, 7 aa, Artificial Sequence
  DME variant alteration
LGKFGQR

SEQ ID NO: 4034 - protein, 8 aa, Artificial Sequence
  DME variant alteration
LGKFGQRA

SEQ ID NO: 4035 - protein, 7 aa, Artificial Sequence
  DME variant alteration
LGNPTHI

SEQ ID NO: 4036 - protein, 4 aa, Artificial Sequence
  DME variant alteration
LHLE

SEQ ID NO: 4037 - protein, 5 aa, Artificial Sequence
  DME variant alteration
LHLEK

SEQ ID NO: 4038 - protein, 7 aa, Artificial Sequence
  DME variant alteration
LHLEKKH

SEQ ID NO: 4039 - protein, 7 aa, Artificial Sequence
  DME variant alteration
LINEKKE

SEQ ID NO: 4040 - protein, 5 aa, Artificial Sequence
  DME variant alteration
LKEAD

SEQ ID NO: 4041 - protein, 7 aa, Artificial Sequence
  DME variant alteration
LKEADKD

SEQ ID NO: 4042 - protein, 5 aa, Artificial Sequence
  DME variant alteration
LKGFP

SEQ ID NO: 4043 - protein, 7 aa, Artificial Sequence
  DME variant alteration
LKVEGQI

SEQ ID NO: 4044 - protein, 4 aa, Artificial Sequence
  DME variant alteration
LLPY

SEQ ID NO: 4045 - protein, 5 aa, Artificial Sequence
  DME variant alteration
LLSPH

SEQ ID NO: 4046 - protein, 6 aa, Artificial Sequence
  DME variant alteration
LLSPHK

SEQ ID NO: 4047 - protein, 4 aa, Artificial Sequence
  DME variant alteration
LLYY

SEQ ID NO: 4048 - protein, 5 aa, Artificial Sequence
  DME variant alteration
LNLYL

SEQ ID NO: 4049 - protein, 6 aa, Artificial Sequence
  DME variant alteration
LNLYLI

SEQ ID NO: 4050 - protein, 4 aa, Artificial Sequence
  DME variant alteration
LPLA

SEQ ID NO: 4051 - protein, 4 aa, Artificial Sequence
  DME variant alteration
LPPQ

SEQ ID NO: 4052 - protein, 6 aa, Artificial Sequence
  DME variant alteration
LPSKTY

SEQ ID NO: 4053 - protein, 7 aa, Artificial Sequence
  DME variant alteration
LPYLSSE

SEQ ID NO: 4054 - protein, 6 aa, Artificial Sequence
  DME variant alteration
LRSPCL

SEQ ID NO: 4055 - protein, 7 aa, Artificial Sequence
  DME variant alteration
LSDACMG

SEQ ID NO: 4056 - protein, 7 aa, Artificial Sequence
  DME variant alteration
LSEESVN

SEQ ID NO: 4057 - protein, 6 aa, Artificial Sequence
  DME variant alteration
LSKTLA

SEQ ID NO: 4058 - protein, 9 aa, Artificial Sequence
  DME variant alteration
LSKTLAQYT

SEQ ID NO: 4059 - protein, 7 aa, Artificial Sequence
  DME variant alteration
LSLETGS

SEQ ID NO: 4060 - protein, 7 aa, Artificial Sequence
  DME variant alteration
LSVELDR

SEQ ID NO: 4061 - protein, 4 aa, Artificial Sequence
  DME variant alteration
LTKY

SEQ ID NO: 4062 - protein, 7 aa, Artificial Sequence
  DME variant alteration
LWPRGST

SEQ ID NO: 4063 - protein, 6 aa, Artificial Sequence
  DME variant alteration
LWQKLK

SEQ ID NO: 4064 - protein, 6 aa, Artificial Sequence
  DME variant alteration
MAERQY

SEQ ID NO: 4065 - protein, 4 aa, Artificial Sequence
  DME variant alteration
MVRN

SEQ ID NO: 4066 - protein, 7 aa, Artificial Sequence
  DME variant alteration
MVRNTAR

SEQ ID NO: 4067 - protein, 4 aa, Artificial Sequence
  DME variant alteration
NCAF

SEQ ID NO: 4068 - protein, 6 aa, Artificial Sequence
  DME variant alteration
NCAFIW

SEQ ID NO: 4069 - protein, 8 aa, Artificial Sequence
  DME variant alteration
NCAFIWQK

SEQ ID NO: 4070 - protein, 7 aa, Artificial Sequence
  DME variant alteration
NDISSWT

SEQ ID NO: 4071 - protein, 6 aa, Artificial Sequence
  DME variant alteration
NEKRLA

SEQ ID NO: 4072 - protein, 7 aa, Artificial Sequence
  DME variant alteration
NGLAFPK

SEQ ID NO: 4073 - protein, 4 aa, Artificial Sequence
  DME variant alteration
NIAR

SEQ ID NO: 4074 - protein, 4 aa, Artificial Sequence
  DME variant alteration
NLSR

SEQ ID NO: 4075 - protein, 6 aa, Artificial Sequence
  DME variant alteration
NSSLSA

SEQ ID NO: 4076 - protein, 8 aa, Artificial Sequence
  DME variant alteration
NSSLSASF

SEQ ID NO: 4077 - protein, 8 aa, Artificial Sequence
  DME variant alteration
NSSLSASF

SEQ ID NO: 4078 - protein, 4 aa, Artificial Sequence
  DME variant alteration
NTDK

SEQ ID NO: 4079 - protein, 7 aa, Artificial Sequence
  DME variant alteration
NVKKLIN

SEQ ID NO: 4080 - protein, 5 aa, Artificial Sequence
  DME variant alteration
NVVAQ

SEQ ID NO: 4081 - protein, 6 aa, Artificial Sequence
  DME variant alteration
NVVAQI

SEQ ID NO: 4082 - protein, 4 aa, Artificial Sequence
  DME variant alteration
NYFK

SEQ ID NO: 4083 - protein, 4 aa, Artificial Sequence
  DME variant alteration
PALF

SEQ ID NO: 4084 - protein, 6 aa, Artificial Sequence
  DME variant alteration
PAVIAL

SEQ ID NO: 4085 - protein, 7 aa, Artificial Sequence
  DME variant alteration
PAVIALT

SEQ ID NO: 4086 - protein, 8 aa, Artificial Sequence
  DME variant alteration
PCTTGEPD

SEQ ID NO: 4087 - protein, 5 aa, Artificial Sequence
  DME variant alteration
PEAFE

SEQ ID NO: 4088 - protein, 7 aa, Artificial Sequence
  DME variant alteration
PEAFEAN

SEQ ID NO: 4089 - protein, 4 aa, Artificial Sequence
  DME variant alteration
PHTK

SEQ ID NO: 4090 - protein, 5 aa, Artificial Sequence
  DME variant alteration
PHTKE

SEQ ID NO: 4091 - protein, 4 aa, Artificial Sequence
  DME variant alteration
PMNL

SEQ ID NO: 4092 - protein, 5 aa, Artificial Sequence
  DME variant alteration
PMNLI

SEQ ID NO: 4093 - protein, 4 aa, Artificial Sequence
  DME variant alteration
PPLL

SEQ ID NO: 4094 - protein, 4 aa, Artificial Sequence
  DME variant alteration
PRLY

SEQ ID NO: 4095 - protein, 4 aa, Artificial Sequence
  DME variant alteration
PSTA

SEQ ID NO: 4096 - protein, 7 aa, Artificial Sequence
  DME variant alteration
PTHILRI

SEQ ID NO: 4097 - protein, 4 aa, Artificial Sequence
  DME variant alteration
PTRD

SEQ ID NO: 4098 - protein, 6 aa, Artificial Sequence
  DME variant alteration
PVKPLE

SEQ ID NO: 4099 - protein, 6 aa, Artificial Sequence
  DME variant alteration
QDAMLI

SEQ ID NO: 4100 - protein, 7 aa, Artificial Sequence
  DME variant alteration
QDEPALF

SEQ ID NO: 4101 - protein, 7 aa, Artificial Sequence
  DME variant alteration
QGKRTFM

SEQ ID NO: 4102 - protein, 4 aa, Artificial Sequence
  DME variant alteration
QGRE

SEQ ID NO: 4103 - protein, 8 aa, Artificial Sequence
  DME variant alteration
QGREFIWN

SEQ ID NO: 4104 - protein, 5 aa, Artificial Sequence
  DME variant alteration
QIGGN

SEQ ID NO: 4105 - protein, 6 aa, Artificial Sequence
  DME variant alteration
QITYYN

SEQ ID NO: 4106 - protein, 5 aa, Artificial Sequence
  DME variant alteration
QKVIK

SEQ ID NO: 4107 - protein, 5 aa, Artificial Sequence
  DME variant alteration
QNVVK

SEQ ID NO: 4108 - protein, 6 aa, Artificial Sequence
  DME variant alteration
QNVVKD

SEQ ID NO: 4109 - protein, 5 aa, Artificial Sequence
  DME variant alteration
QRALD

SEQ ID NO: 4110 - protein, 8 aa, Artificial Sequence
  DME variant alteration
QRALDFYS

SEQ ID NO: 4111 - protein, 4 aa, Artificial Sequence
  DME variant alteration
QRLK

SEQ ID NO: 4112 - protein, 4 aa, Artificial Sequence
  DME variant alteration
QRTI

SEQ ID NO: 4113 - protein, 6 aa, Artificial Sequence
  DME variant alteration
QRTIQA

SEQ ID NO: 4114 - protein, 7 aa, Artificial Sequence
  DME variant alteration
QSFYRKK

SEQ ID NO: 4115 - protein, 5 aa, Artificial Sequence
  DME variant alteration
QTNKT

SEQ ID NO: 4116 - protein, 7 aa, Artificial Sequence
  DME variant alteration
QTNKTTG

SEQ ID NO: 4117 - protein, 6 aa, Artificial Sequence
  DME variant alteration
QYTSKT

SEQ ID NO: 4118 - protein, 5 aa, Artificial Sequence
  DME variant alteration
RAKAS

SEQ ID NO: 4119 - protein, 5 aa, Artificial Sequence
  DME variant alteration
RASLA

SEQ ID NO: 4120 - protein, 5 aa, Artificial Sequence
  DME variant alteration
REFIW

SEQ ID NO: 4121 - protein, 9 aa, Artificial Sequence
  DME variant alteration
REFIWNDLL

SEQ ID NO: 4122 - protein, 5 aa, Artificial Sequence
  DME variant alteration
RESNH

SEQ ID NO: 4123 - protein, 5 aa, Artificial Sequence
  DME variant alteration
RFYTV

SEQ ID NO: 4124 - protein, 9 aa, Artificial Sequence
  DME variant alteration
RFYTVINKK

SEQ ID NO: 4125 - protein, 4 aa, Artificial Sequence
  DME variant alteration
RGRP

SEQ ID NO: 4126 - protein, 4 aa, Artificial Sequence
  DME variant alteration
RKYA

SEQ ID NO: 4127 - protein, 5 aa, Artificial Sequence
  DME variant alteration
RNRSA

SEQ ID NO: 4128 - protein, 6 aa, Artificial Sequence
  DME variant alteration
RNRSAA

SEQ ID NO: 4129 - protein, 6 aa, Artificial Sequence
  DME variant alteration
RNTARD

SEQ ID NO: 4130 - protein, 9 aa, Artificial Sequence
  DME variant alteration
RNTARDLLY

SEQ ID NO: 4131 - protein, 10 aa, Artificial Sequence
  DME variant alteration
RPGRESTRRW

SEQ ID NO: 4132 - protein, 4 aa, Artificial Sequence
  DME variant alteration
RPSR

SEQ ID NO: 4133 - protein, 7 aa, Artificial Sequence
  DME variant alteration
RQANEVD

SEQ ID NO: 4134 - protein, 4 aa, Artificial Sequence
  DME variant alteration
RQGK

SEQ ID NO: 4135 - protein, 5 aa, Artificial Sequence
  DME variant alteration
RQGRE

SEQ ID NO: 4136 - protein, 8 aa, Artificial Sequence
  DME variant alteration
RQNVVKDL

SEQ ID NO: 4137 - protein, 4 aa, Artificial Sequence
  DME variant alteration
RQYT

SEQ ID NO: 4138 - protein, 5 aa, Artificial Sequence
  DME variant alteration
RRTRQ

SEQ ID NO: 4139 - protein, 5 aa, Artificial Sequence
  DME variant alteration
RSGEA

SEQ ID NO: 4140 - protein, 6 aa, Artificial Sequence
  DME variant alteration
RSQEYK

SEQ ID NO: 4141 - protein, 5 aa, Artificial Sequence
  DME variant alteration
RSTAR

SEQ ID NO: 4142 - protein, 7 aa, Artificial Sequence
  DME variant alteration
RTATQRR

SEQ ID NO: 4143 - protein, 4 aa, Artificial Sequence
  DME variant alteration
RTFM

SEQ ID NO: 4144 - protein, 6 aa, Artificial Sequence
  DME variant alteration
RTFMAE

SEQ ID NO: 4145 - protein, 7 aa, Artificial Sequence
  DME variant alteration
RTIQAAK

SEQ ID NO: 4146 - protein, 7 aa, Artificial Sequence
  DME variant alteration
RTSTAST

SEQ ID NO: 4147 - protein, 7 aa, Artificial Sequence
  DME variant alteration
RTSTAST

SEQ ID NO: 4148 - protein, 5 aa, Artificial Sequence
  DME variant alteration
SEEDR

SEQ ID NO: 4149 - protein, 4 aa, Artificial Sequence
  DME variant alteration
SFVI

SEQ ID NO: 4150 - protein, 5 aa, Artificial Sequence
  DME variant alteration
SFVIE

SEQ ID NO: 4151 - protein, 8 aa, Artificial Sequence
  DME variant alteration
SFVIEGLK

SEQ ID NO: 4152 - protein, 4 aa, Artificial Sequence
  DME variant alteration
SFYR

SEQ ID NO: 4153 - protein, 4 aa, Artificial Sequence
  DME variant alteration
SGCV

SEQ ID NO: 4154 - protein, 4 aa, Artificial Sequence
  DME variant alteration
SGEI

SEQ ID NO: 4155 - protein, 5 aa, Artificial Sequence
  DME variant alteration
SGEIV

SEQ ID NO: 4156 - protein, 5 aa, Artificial Sequence
  DME variant alteration
SHCRD

SEQ ID NO: 4157 - protein, 4 aa, Artificial Sequence
  DME variant alteration
SHLQ

SEQ ID NO: 4158 - protein, 6 aa, Artificial Sequence
  DME variant alteration
SHLQNS

SEQ ID NO: 4159 - protein, 4 aa, Artificial Sequence
  DME variant alteration
SHTA

SEQ ID NO: 4160 - protein, 9 aa, Artificial Sequence
  DME variant alteration
SHTAWASSD

SEQ ID NO: 4161 - protein, 7 aa, Artificial Sequence
  DME variant alteration
SIHVTRE

SEQ ID NO: 4162 - protein, 4 aa, Artificial Sequence
  DME variant alteration
SKQY

SEQ ID NO: 4163 - protein, 6 aa, Artificial Sequence
  DME variant alteration
SKTLAQ

SEQ ID NO: 4164 - protein, 6 aa, Artificial Sequence
  DME variant alteration
SLGKFG

SEQ ID NO: 4165 - protein, 5 aa, Artificial Sequence
  DME variant alteration
SLKLA

SEQ ID NO: 4166 - protein, 8 aa, Artificial Sequence
  DME variant alteration
SLLKKRFS

SEQ ID NO: 4167 - protein, 4 aa, Artificial Sequence
  DME variant alteration
SNHP

SEQ ID NO: 4168 - protein, 7 aa, Artificial Sequence
  DME variant alteration
SNHPVKP

SEQ ID NO: 4169 - protein, 4 aa, Artificial Sequence
  DME variant alteration
SPAR

SEQ ID NO: 4170 - protein, 5 aa, Artificial Sequence
  DME variant alteration
SPERR

SEQ ID NO: 4171 - protein, 5 aa, Artificial Sequence
  DME variant alteration
SRFKD

SEQ ID NO: 4172 - protein, 7 aa, Artificial Sequence
  DME variant alteration
SRTATQR

SEQ ID NO: 4173 - protein, 4 aa, Artificial Sequence
  DME variant alteration
SSSL

SEQ ID NO: 4174 - protein, 8 aa, Artificial Sequence
  DME variant alteration
SSSLASGL

SEQ ID NO: 4175 - protein, 4 aa, Artificial Sequence
  DME variant alteration
SVNN

SEQ ID NO: 4176 - protein, 6 aa, Artificial Sequence
  DME variant alteration
SVNNDI

SEQ ID NO: 4177 - protein, 5 aa, Artificial Sequence
  DME variant alteration
SVSSK

SEQ ID NO: 4178 - protein, 5 aa, Artificial Sequence
  DME variant alteration
SWLFL

SEQ ID NO: 4179 - protein, 6 aa, Artificial Sequence
  DME variant alteration
TAKLAY

SEQ ID NO: 4180 - protein, 8 aa, Artificial Sequence
  DME variant alteration
TAKLAYEG

SEQ ID NO: 4181 - protein, 4 aa, Artificial Sequence
  DME variant alteration
TCSN

SEQ ID NO: 4182 - protein, 6 aa, Artificial Sequence
  DME variant alteration
TCSNCG

SEQ ID NO: 4183 - protein, 8 aa, Artificial Sequence
  DME variant alteration
TCSNCGFT

SEQ ID NO: 4184 - protein, 5 aa, Artificial Sequence
  DME variant alteration
TDPEG

SEQ ID NO: 4185 - protein, 7 aa, Artificial Sequence
  DME variant alteration
TDPEGCP

SEQ ID NO: 4186 - protein, 6 aa, Artificial Sequence
  DME variant alteration
TFERRE

SEQ ID NO: 4187 - protein, 7 aa, Artificial Sequence
  DME variant alteration
TFERREV

SEQ ID NO: 4188 - protein, 8 aa, Artificial Sequence
  DME variant alteration
THAAEQAA

SEQ ID NO: 4189 - protein, 4 aa, Artificial Sequence
  DME variant alteration
TIQA

SEQ ID NO: 4190 - protein, 6 aa, Artificial Sequence
  DME variant alteration
TLAQYT

SEQ ID NO: 4191 - protein, 5 aa, Artificial Sequence
  DME variant alteration
TLPPQ

SEQ ID NO: 4192 - protein, 8 aa, Artificial Sequence
  DME variant alteration
TNYFGRCN

SEQ ID NO: 4193 - protein, 10 aa, Artificial Sequence
  DME variant alteration
TPTTSADATC

SEQ ID NO: 4194 - protein, 4 aa, Artificial Sequence
  DME variant alteration
TRME

SEQ ID NO: 4195 - protein, 5 aa, Artificial Sequence
  DME variant alteration
TSKTC

SEQ ID NO: 4196 - protein, 5 aa, Artificial Sequence
  DME variant alteration
TTING

SEQ ID NO: 4197 - protein, 7 aa, Artificial Sequence
  DME variant alteration
TTINGKE

SEQ ID NO: 4198 - protein, 8 aa, Artificial Sequence
  DME variant alteration
VAKPLLQQ

SEQ ID NO: 4199 - protein, 4 aa, Artificial Sequence
  DME variant alteration
VAQI

SEQ ID NO: 4200 - protein, 5 aa, Artificial Sequence
  DME variant alteration
VASFL

SEQ ID NO: 4201 - protein, 6 aa, Artificial Sequence
  DME variant alteration
VASFLT

SEQ ID NO: 4202 - protein, 5 aa, Artificial Sequence
  DME variant alteration
VCLNC

SEQ ID NO: 4203 - protein, 8 aa, Artificial Sequence
  DME variant alteration
VCNVKKLI

SEQ ID NO: 4204 - protein, 5 aa, Artificial Sequence
  DME variant alteration
VDWWD

SEQ ID NO: 4205 - protein, 6 aa, Artificial Sequence
  DME variant alteration
VEGQIT

SEQ ID NO: 4206 - protein, 4 aa, Artificial Sequence
  DME variant alteration
VEQR

SEQ ID NO: 4207 - protein, 5 aa, Artificial Sequence
  DME variant alteration
VEQRR

SEQ ID NO: 4208 - protein, 7 aa, Artificial Sequence
  DME variant alteration
VERQANE

SEQ ID NO: 4209 - protein, 7 aa, Artificial Sequence
  DME variant alteration
VIEKTLY

SEQ ID NO: 4210 - protein, 8 aa, Artificial Sequence
  DME variant alteration
VIEKTLYN

SEQ ID NO: 4211 - protein, 5 aa, Artificial Sequence
  DME variant alteration
VKPLE

SEQ ID NO: 4212 - protein, 7 aa, Artificial Sequence
  DME variant alteration
VKPLEQI

SEQ ID NO: 4213 - protein, 8 aa, Artificial Sequence
  DME variant alteration
VLDSSNIK

SEQ ID NO: 4214 - protein, 4 aa, Artificial Sequence
  DME variant alteration
VLEK

SEQ ID NO: 4215 - protein, 4 aa, Artificial Sequence
  DME variant alteration
VPSK

SEQ ID NO: 4216 - protein, 4 aa, Artificial Sequence
  DME variant alteration
VSCK

SEQ ID NO: 4217 - protein, 5 aa, Artificial Sequence
  DME variant alteration
VSEHE

SEQ ID NO: 4218 - protein, 7 aa, Artificial Sequence
  DME variant alteration
VSEHERL

SEQ ID NO: 4219 - protein, 8 aa, Artificial Sequence
  DME variant alteration
VSEHERLI

SEQ ID NO: 4220 - protein, 4 aa, Artificial Sequence
  DME variant alteration
VSIK

SEQ ID NO: 4221 - protein, 11 aa, Artificial Sequence
  DME variant alteration
VSIKDLQASNK

SEQ ID NO: 4222 - protein, 4 aa, Artificial Sequence
  DME variant alteration
VSRK

SEQ ID NO: 4223 - protein, 4 aa, Artificial Sequence
  DME variant alteration
VSSE

SEQ ID NO: 4224 - protein, 11 aa, Artificial Sequence
  DME variant alteration
VSSEDLQASNK

SEQ ID NO: 4225 - protein, 5 aa, Artificial Sequence
  DME variant alteration
VSSKA

SEQ ID NO: 4226 - protein, 7 aa, Artificial Sequence
  DME variant alteration
VSSKDFQ

SEQ ID NO: 4227 - protein, 6 aa, Artificial Sequence
  DME variant alteration
VSSKDH

SEQ ID NO: 4228 - protein, 6 aa, Artificial Sequence
  DME variant alteration
VSSKDI

SEQ ID NO: 4229 - protein, 7 aa, Artificial Sequence
  DME variant alteration
VSSKDLH

SEQ ID NO: 4230 - protein, 10 aa, Artificial Sequence
  DME variant alteration
VSSKDLHASN

SEQ ID NO: 4231 - protein, 10 aa, Artificial Sequence
  DME variant alteration
VSSKDLQACL

SEQ ID NO: 4232 - protein, 11 aa, Artificial Sequence
  DME variant alteration
VSSKDLQASNN

SEQ ID NO: 4233 - protein, 11 aa, Artificial Sequence
  DME variant alteration
VSSKDLQASNT

SEQ ID NO: 4234 - protein, 8 aa, Artificial Sequence
  DME variant alteration
VSSKDLQE

SEQ ID NO: 4235 - protein, 8 aa, Artificial Sequence
  DME variant alteration
VSSKDLQG

SEQ ID NO: 4236 - protein, 7 aa, Artificial Sequence
  DME variant alteration
VSSKDLV

SEQ ID NO: 4237 - protein, 6 aa, Artificial Sequence
  DME variant alteration
VSSKDP

SEQ ID NO: 4238 - protein, 6 aa, Artificial Sequence
  DME variant alteration
VSSKDV

SEQ ID NO: 4239 - protein, 6 aa, Artificial Sequence
  DME variant alteration
VSSKDV

SEQ ID NO: 4240 - protein, 7 aa, Artificial Sequence
  DME variant alteration
VSSKDVQ

SEQ ID NO: 4241 - protein, 7 aa, Artificial Sequence
  DME variant alteration
VSSKVLQ

SEQ ID NO: 4242 - protein, 11 aa, Artificial Sequence
  DME variant alteration
VSSKYLQASNK

SEQ ID NO: 4243 - protein, 4 aa, Artificial Sequence
  DME variant alteration
VSSN

SEQ ID NO: 4244 - protein, 5 aa, Artificial Sequence
  DME variant alteration
VSSND

SEQ ID NO: 4245 - protein, 7 aa, Artificial Sequence
  DME variant alteration
VSSNDLQ

SEQ ID NO: 4246 - protein, 10 aa, Artificial Sequence
  DME variant alteration
VSSNDLQASN

SEQ ID NO: 4247 - protein, 11 aa, Artificial Sequence
  DME variant alteration
VSSNDLQASNK

SEQ ID NO: 4248 - protein, 4 aa, Artificial Sequence
  DME variant alteration
VSSR

SEQ ID NO: 4249 - protein, 4 aa, Artificial Sequence
  DME variant alteration
VVAQ

SEQ ID NO: 4250 - protein, 5 aa, Artificial Sequence
  DME variant alteration
VVAQI

SEQ ID NO: 4251 - protein, 5 aa, Artificial Sequence
  DME variant alteration
VWKPA

SEQ ID NO: 4252 - protein, 6 aa, Artificial Sequence
  DME variant alteration
VWKPAV

SEQ ID NO: 4253 - protein, 8 aa, Artificial Sequence
  DME variant alteration
WGKVYDEA

SEQ ID NO: 4254 - protein, 4 aa, Artificial Sequence
  DME variant alteration
WLFL

SEQ ID NO: 4255 - protein, 5 aa, Artificial Sequence
  DME variant alteration
WNDLL

SEQ ID NO: 4256 - protein, 4 aa, Artificial Sequence
  DME variant alteration
WPRS

SEQ ID NO: 4257 - protein, 5 aa, Artificial Sequence
  DME variant alteration
WTKGR

SEQ ID NO: 4258 - protein, 5 aa, Artificial Sequence
  DME variant alteration
WVNLN

SEQ ID NO: 4259 - protein, 5 aa, Artificial Sequence
  DME variant alteration
WWDMV

SEQ ID NO: 4260 - protein, 6 aa, Artificial Sequence
  DME variant alteration
YDEAWE

SEQ ID NO: 4261 - protein, 6 aa, Artificial Sequence
  DME variant alteration
YEGLPS

SEQ ID NO: 4262 - protein, 5 aa, Artificial Sequence
  DME variant alteration
YGDLR

SEQ ID NO: 4263 - protein, 5 aa, Artificial Sequence
  DME variant alteration
YKKYQ

SEQ ID NO: 4264 - protein, 5 aa, Artificial Sequence
  DME variant alteration
YLIIN

SEQ ID NO: 4265 - protein, 7 aa, Artificial Sequence
  DME variant alteration
YLSKTLA

SEQ ID NO: 4266 - protein, 6 aa, Artificial Sequence
  DME variant alteration
YNRRTR

SEQ ID NO: 4267 - protein, 5 aa, Artificial Sequence
  DME variant alteration
YNRYK

SEQ ID NO: 4268 - protein, 4 aa, Artificial Sequence
  DME variant alteration
YQFG

SEQ ID NO: 4269 - protein, 4 aa, Artificial Sequence
  DME variant alteration
YQTN

SEQ ID NO: 4270 - protein, 4 aa, Artificial Sequence
  DME variant alteration
YTRM

SEQ ID NO: 4271 - protein, 5 aa, Artificial Sequence
  DME variant alteration
YTRME

SEQ ID NO: 4272 - protein, 6 aa, Artificial Sequence
  DME variant alteration
YTRMED

SEQ ID NO: 4273 - protein, 4 aa, Artificial Sequence
  DME variant alteration
YTSK

SEQ ID NO: 4274 - protein, 7 aa, Artificial Sequence
  DME variant alteration
YTVINKK

SEQ ID NO: 4275 - protein, 7 aa, Artificial Sequence
  DME variant alteration
YVSSKDL

SEQ ID NO: 4276 - protein, 8 aa, Artificial Sequence
  DME variant alteration
YVSSKDLQ

SEQ ID NO: 4277 - protein, 9 aa, Artificial Sequence
  DME variant alteration
YVSSKDLQA

SEQ ID NO: 4278 - RNA, 19 nt, Unknown
  exogenous stem loop region
acaugaggauuacccaugu

SEQ ID NO: 4279 - RNA, 18 nt, Unknown
  exogenous stem loop region
ugcaugucuaagacagca

SEQ ID NO: 4280 - RNA, 20 nt, Unknown
  exogenous stem loop region
aauccauugcacuccggauu

SEQ ID NO: 4281 - RNA, 12 nt, Unknown
  exogenous stem loop region
ccucuucggagg

SEQ ID NO: 4282 - RNA, 21 nt, Unknown
  exogenous stem loop region
aggaguuucuauggaaacccu

SEQ ID NO: 4283 - RNA, 30 nt, Unknown
  exogenous stem loop region
aggugggacgaccucucggucguccuaucu

SEQ ID NO: 4284 - RNA, 19 nt, Unknown
  exogenous stem loop region
ugcucgcuccguucgagca

SEQ ID NO: 4285 - RNA, 21 nt, Unknown
  exogenous stem loop region
ugcucgacgcguccucgagca

SEQ ID NO: 4286 - RNA, 22 nt, Unknown
  exogenous stem loop region
ugcucguuugcggcuacgagca

SEQ ID NO: 4287 - RNA, 17 nt, Unknown
  exogenous stem loop region
agggagggagggagagg

SEQ ID NO: 4288 - RNA, 19 nt, Unknown
  exogenous stem loop region
gguuaggguuaggguuagg

SEQ ID NO: 4289 - RNA, 25 nt, Unknown
  exogenous stem loop region
cugcucaguacgagaggaaccgcag

SEQ ID NO: 4290 - RNA, 78 nt, Unknown
  exogenous stem loop region
uacacugggaucgcugaauuagagaucggcguccuuucauucuauauacuuuggaguuuuaaaaugucucuaaguaca

SEQ ID NO: 4291 - RNA, 29 nt, Unknown
  extended stem region
gcgcuuacggacuucgguccguaagaagc

SEQ ID NO: 4292 - RNA, 20 nt, Unknown
  extended stem region
gcucccucuucggagggagc

SEQ ID NO: 4293 - RNA, 27 nt, Unknown
  extended stem region
gcucacaugaggaucacccaugugagc

SEQ ID NO: 4294 - DNA, 64 bp, Artificial Sequence
  PCR2_Rvs_v1_002
caagcagaagacggcatacgagatacatcggtgactggagttcagacgtgtgctcttccgatct

SEQ ID NO: 4295 - DNA, 64 bp, Artificial Sequence
  PCR2_Rvs_v1_003
caagcagaagacggcatacgagatgcctaagtgactggagttcagacgtgtgctcttccgatct

SEQ ID NO: 4296 - DNA, 64 bp, Artificial Sequence
  PCR2_Rvs_v1_004
caagcagaagacggcatacgagattggtcagtgactggagttcagacgtgtgctcttccgatct

SEQ ID NO: 4297 - DNA, 64 bp, Artificial Sequence
  PCR2_Rvs_v1_005
caagcagaagacggcatacgagatcactgtgtgactggagttcagacgtgtgctcttccgatct

SEQ ID NO: 4298 - DNA, 64 bp, Artificial Sequence
  PCR2_Rvs_v1_006
caagcagaagacggcatacgagatattggcgtgactggagttcagacgtgtgctcttccgatct

SEQ ID NO: 4299 - DNA, 64 bp, Artificial Sequence
  PCR2_Rvs_v1_007
caagcagaagacggcatacgagatgatctggtgactggagttcagacgtgtgctcttccgatct

SEQ ID NO: 4300 - DNA, 64 bp, Artificial Sequence
  PCR2_Rvs_v1_008
caagcagaagacggcatacgagattcaagtgtgactggagttcagacgtgtgctcttccgatct

SEQ ID NO: 4301 - DNA, 64 bp, Artificial Sequence
  PCR2_Rvs_v1_009
caagcagaagacggcatacgagatctgatcgtgactggagttcagacgtgtgctcttccgatct

SEQ ID NO: 4302 - DNA, 64 bp, Artificial Sequence
  PCR2_Rvs_v1_010
caagcagaagacggcatacgagataagctagtgactggagttcagacgtgtgctcttccgatct

SEQ ID NO: 4303 - DNA, 64 bp, Artificial Sequence
  PCR2_Rvs_v1_011
caagcagaagacggcatacgagatgtagccgtgactggagttcagacgtgtgctcttccgatct

SEQ ID NO: 4304 - DNA, 64 bp, Artificial Sequence
  PCR2_Rvs_v1_012
caagcagaagacggcatacgagattacaaggtgactggagttcagacgtgtgctcttccgatct

SEQ ID NO: 4305 - DNA, 64 bp, Artificial Sequence
  PCR2_Rvs_v1_013
caagcagaagacggcatacgagatttgactgtgactggagttcagacgtgtgctcttccgatct

SEQ ID NO: 4306 - DNA, 64 bp, Artificial Sequence
  PCR2_Rvs_v1_014
caagcagaagacggcatacgagatggaactgtgactggagttcagacgtgtgctcttccgatct

SEQ ID NO: 4307 - DNA, 64 bp, Artificial Sequence
  PCR2_Rvs_v1_015
caagcagaagacggcatacgagattgacatgtgactggagttcagacgtgtgctcttccgatct

SEQ ID NO: 4308 - DNA, 64 bp, Artificial Sequence
  PCR2_Rvs_v1_016
caagcagaagacggcatacgagatggacgggtgactggagttcagacgtgtgctcttccgatct

SEQ ID NO: 4309 - DNA, 64 bp, Artificial Sequence
  PCR2_Rvs_v1_017
caagcagaagacggcatacgagatctctacgtgactggagttcagacgtgtgctcttccgatct

SEQ ID NO: 4310 - DNA, 64 bp, Artificial Sequence
  PCR2_Rvs_v1_018
caagcagaagacggcatacgagatgcggacgtgactggagttcagacgtgtgctcttccgatct

SEQ ID NO: 4311 - DNA, 64 bp, Artificial Sequence
  PCR2_Rvs_v1_019
caagcagaagacggcatacgagattttcacgtgactggagttcagacgtgtgctcttccgatct

SEQ ID NO: 4312 - DNA, 64 bp, Artificial Sequence
  PCR2_Rvs_v1_020
caagcagaagacggcatacgagatggccacgtgactggagttcagacgtgtgctcttccgatct

SEQ ID NO: 4313 - DNA, 64 bp, Artificial Sequence
  PCR2_Rvs_v1_021
caagcagaagacggcatacgagatcgaaacgtgactggagttcagacgtgtgctcttccgatct

SEQ ID NO: 4314 - DNA, 64 bp, Artificial Sequence
  PCR2_Rvs_v1_022
caagcagaagacggcatacgagatcgtacggtgactggagttcagacgtgtgctcttccgatct

SEQ ID NO: 4315 - DNA, 64 bp, Artificial Sequence
  PCR2_Rvs_v1_023
caagcagaagacggcatacgagatccactcgtgactggagttcagacgtgtgctcttccgatct

SEQ ID NO: 4316 - DNA, 64 bp, Artificial Sequence
  PCR2_Rvs_v1_024
caagcagaagacggcatacgagatgctaccgtgactggagttcagacgtgtgctcttccgatct

SEQ ID NO: 4317 - DNA, 64 bp, Artificial Sequence
  PCR2_Rvs_v1_025
caagcagaagacggcatacgagatatcagtgtgactggagttcagacgtgtgctcttccgatct

SEQ ID NO: 4318 - DNA, 64 bp, Artificial Sequence
  PCR2_Rvs_v1_026
caagcagaagacggcatacgagatgctcatgtgactggagttcagacgtgtgctcttccgatct

SEQ ID NO: 4319 - DNA, 64 bp, Artificial Sequence
  PCR2_Rvs_v1_027
caagcagaagacggcatacgagataggaatgtgactggagttcagacgtgtgctcttccgatct

SEQ ID NO: 4320 - DNA, 64 bp, Artificial Sequence
  PCR2_Rvs_v1_028
caagcagaagacggcatacgagatcttttggtgactggagttcagacgtgtgctcttccgatct

SEQ ID NO: 4321 - DNA, 64 bp, Artificial Sequence
  PCR2_Rvs_v1_029
caagcagaagacggcatacgagattagttggtgactggagttcagacgtgtgctcttccgatct

SEQ ID NO: 4322 - DNA, 64 bp, Artificial Sequence
  PCR2_Rvs_v1_030
caagcagaagacggcatacgagatccggtggtgactggagttcagacgtgtgctcttccgatct

SEQ ID NO: 4323 - DNA, 64 bp, Artificial Sequence
  PCR2_Rvs_v1_031
caagcagaagacggcatacgagatatcgtggtgactggagttcagacgtgtgctcttccgatct

SEQ ID NO: 4324 - DNA, 64 bp, Artificial Sequence
  PCR2_Rvs_v1_032
caagcagaagacggcatacgagattgagtggtgactggagttcagacgtgtgctcttccgatct

SEQ ID NO: 4325 - DNA, 64 bp, Artificial Sequence
  PCR2_Rvs_v1_033
caagcagaagacggcatacgagatcgcctggtgactggagttcagacgtgtgctcttccgatct

SEQ ID NO: 4326 - DNA, 64 bp, Artificial Sequence
  PCR2_Rvs_v1_034
caagcagaagacggcatacgagatgccatggtgactggagttcagacgtgtgctcttccgatct

SEQ ID NO: 4327 - DNA, 64 bp, Artificial Sequence
  PCR2_Rvs_v1_035
caagcagaagacggcatacgagataaaatggtgactggagttcagacgtgtgctcttccgatct

SEQ ID NO: 4328 - DNA, 64 bp, Artificial Sequence
  PCR2_Rvs_v1_036
caagcagaagacggcatacgagattgttgggtgactggagttcagacgtgtgctcttccgatct

SEQ ID NO: 4329 - DNA, 64 bp, Artificial Sequence
  PCR2_Rvs_v1_037
caagcagaagacggcatacgagatattccggtgactggagttcagacgtgtgctcttccgatct

SEQ ID NO: 4330 - DNA, 64 bp, Artificial Sequence
  PCR2_Rvs_v1_038
caagcagaagacggcatacgagatagctaggtgactggagttcagacgtgtgctcttccgatct

SEQ ID NO: 4331 - DNA, 64 bp, Artificial Sequence
  PCR2_Rvs_v1_039
caagcagaagacggcatacgagatgtataggtgactggagttcagacgtgtgctcttccgatct

SEQ ID NO: 4332 - DNA, 64 bp, Artificial Sequence
  PCR2_Rvs_v1_040
caagcagaagacggcatacgagattctgaggtgactggagttcagacgtgtgctcttccgatct

SEQ ID NO: 4333 - DNA, 64 bp, Artificial Sequence
  PCR2_Rvs_v1_041
caagcagaagacggcatacgagatgtcgtcgtgactggagttcagacgtgtgctcttccgatct

SEQ ID NO: 4334 - DNA, 64 bp, Artificial Sequence
  PCR2_Rvs_v1_042
caagcagaagacggcatacgagatcgattagtgactggagttcagacgtgtgctcttccgatct

SEQ ID NO: 4335 - DNA, 64 bp, Artificial Sequence
  PCR2_Rvs_v1_043
caagcagaagacggcatacgagatgctgtagtgactggagttcagacgtgtgctcttccgatct

SEQ ID NO: 4336 - DNA, 64 bp, Artificial Sequence
  PCR2_Rvs_v1_044
caagcagaagacggcatacgagatattatagtgactggagttcagacgtgtgctcttccgatct

SEQ ID NO: 4337 - DNA, 64 bp, Artificial Sequence
  PCR2_Rvs_v1_045
caagcagaagacggcatacgagatgaatgagtgactggagttcagacgtgtgctcttccgatct

SEQ ID NO: 4338 - DNA, 64 bp, Artificial Sequence
  PCR2_Rvs_v1_046
caagcagaagacggcatacgagattcgggagtgactggagttcagacgtgtgctcttccgatct

SEQ ID NO: 4339 - DNA, 64 bp, Artificial Sequence
  PCR2_Rvs_v1_047
caagcagaagacggcatacgagatcttcgagtgactggagttcagacgtgtgctcttccgatct

SEQ ID NO: 4340 - DNA, 64 bp, Artificial Sequence
  PCR2_Rvs_v1_048
caagcagaagacggcatacgagattgccgagtgactggagttcagacgtgtgctcttccgatct

SEQ ID NO: 4341 - DNA, 61 bp, Artificial Sequence
  PCR2_Rvs_v2_001
caagcagaagacggcatacgagataaccgcgggtgactggagttcagacgtgtgctcttcc

SEQ ID NO: 4342 - DNA, 61 bp, Artificial Sequence
  PCR2_Rvs_v2_002
caagcagaagacggcatacgagatggttataagtgactggagttcagacgtgtgctcttcc

SEQ ID NO: 4343 - DNA, 61 bp, Artificial Sequence
  PCR2_Rvs_v2_003
caagcagaagacggcatacgagatccaagtccgtgactggagttcagacgtgtgctcttcc

SEQ ID NO: 4344 - DNA, 61 bp, Artificial Sequence
  PCR2_Rvs_v2_004
caagcagaagacggcatacgagatttggacttgtgactggagttcagacgtgtgctcttcc

SEQ ID NO: 4345 - DNA, 61 bp, Artificial Sequence
  PCR2_Rvs_v2_005
caagcagaagacggcatacgagatcagtggatgtgactggagttcagacgtgtgctcttcc

SEQ ID NO: 4346 - DNA, 61 bp, Artificial Sequence
  PCR2_Rvs_v2_006
caagcagaagacggcatacgagattgacaagcgtgactggagttcagacgtgtgctcttcc

SEQ ID NO: 4347 - DNA, 61 bp, Artificial Sequence
  PCR2_Rvs_v2_007
caagcagaagacggcatacgagatctagcttggtgactggagttcagacgtgtgctcttcc

SEQ ID NO: 4348 - DNA, 61 bp, Artificial Sequence
  PCR2_Rvs_v2_008
caagcagaagacggcatacgagattcgatccagtgactggagttcagacgtgtgctcttcc

SEQ ID NO: 4349 - DNA, 61 bp, Artificial Sequence
  PCR2_Rvs_v2_009
caagcagaagacggcatacgagatcctgaactgtgactggagttcagacgtgtgctcttcc

SEQ ID NO: 4350 - DNA, 61 bp, Artificial Sequence
  PCR2_Rvs_v2_010
caagcagaagacggcatacgagatttcaggtcgtgactggagttcagacgtgtgctcttcc

SEQ ID NO: 4351 - DNA, 61 bp, Artificial Sequence
  PCR2_Rvs_v2_011
caagcagaagacggcatacgagatagtagagagtgactggagttcagacgtgtgctcttcc

SEQ ID NO: 4352 - DNA, 61 bp, Artificial Sequence
  PCR2_Rvs_v2_012
caagcagaagacggcatacgagatgacgagaggtgactggagttcagacgtgtgctcttcc

SEQ ID NO: 4353 - DNA, 61 bp, Artificial Sequence
  PCR2_Rvs_v2_013
caagcagaagacggcatacgagatagacttgggtgactggagttcagacgtgtgctcttcc

SEQ ID NO: 4354 - DNA, 61 bp, Artificial Sequence
  PCR2_Rvs_v2_014
caagcagaagacggcatacgagatgagtccaagtgactggagttcagacgtgtgctcttcc

SEQ ID NO: 4355 - DNA, 61 bp, Artificial Sequence
  PCR2_Rvs_v2_015
caagcagaagacggcatacgagatcttaagccgtgactggagttcagacgtgtgctcttcc

SEQ ID NO: 4356 - DNA, 61 bp, Artificial Sequence
  PCR2_Rvs_v2_016
caagcagaagacggcatacgagattccggattgtgactggagttcagacgtgtgctcttcc

SEQ ID NO: 4357 - DNA, 61 bp, Artificial Sequence
  PCR2_Rvs_v2_017
caagcagaagacggcatacgagatctgtattagtgactggagttcagacgtgtgctcttcc

SEQ ID NO: 4358 - DNA, 61 bp, Artificial Sequence
  PCR2_Rvs_v2_018
caagcagaagacggcatacgagattcacgccggtgactggagttcagacgtgtgctcttcc

SEQ ID NO: 4359 - DNA, 61 bp, Artificial Sequence
  PCR2_Rvs_v2_019
caagcagaagacggcatacgagatacttacatgtgactggagttcagacgtgtgctcttcc

SEQ ID NO: 4360 - DNA, 61 bp, Artificial Sequence
  PCR2_Rvs_v2_020
caagcagaagacggcatacgagatgtccgtgcgtgactggagttcagacgtgtgctcttcc

SEQ ID NO: 4361 - DNA, 61 bp, Artificial Sequence
  PCR2_Rvs_v2_021
caagcagaagacggcatacgagataaggtaccgtgactggagttcagacgtgtgctcttcc

SEQ ID NO: 4362 - DNA, 61 bp, Artificial Sequence
  PCR2_Rvs_v2_022
caagcagaagacggcatacgagatggaacgttgtgactggagttcagacgtgtgctcttcc

SEQ ID NO: 4363 - DNA, 61 bp, Artificial Sequence
  PCR2_Rvs_v2_023
caagcagaagacggcatacgagataattctgcgtgactggagttcagacgtgtgctcttcc

SEQ ID NO: 4364 - DNA, 61 bp, Artificial Sequence
  PCR2_Rvs_v2_024
caagcagaagacggcatacgagatggcctcatgtgactggagttcagacgtgtgctcttcc

SEQ ID NO: 4365 - DNA, 61 bp, Artificial Sequence
  PCR2_Rvs_v2_025
caagcagaagacggcatacgagatatcttagtgtgactggagttcagacgtgtgctcttcc

SEQ ID NO: 4366 - DNA, 61 bp, Artificial Sequence
  PCR2_Rvs_v2_026
caagcagaagacggcatacgagatgctccgacgtgactggagttcagacgtgtgctcttcc

SEQ ID NO: 4367 - DNA, 61 bp, Artificial Sequence
  PCR2_Rvs_v2_027
caagcagaagacggcatacgagatataccaaggtgactggagttcagacgtgtgctcttcc

SEQ ID NO: 4368 - DNA, 61 bp, Artificial Sequence
  PCR2_Rvs_v2_028
caagcagaagacggcatacgagatgcgttggagtgactggagttcagacgtgtgctcttcc

SEQ ID NO: 4369 - DNA, 61 bp, Artificial Sequence
  PCR2_Rvs_v2_029
caagcagaagacggcatacgagatcttcacgggtgactggagttcagacgtgtgctcttcc

SEQ ID NO: 4370 - DNA, 61 bp, Artificial Sequence
  PCR2_Rvs_v2_030
caagcagaagacggcatacgagattcctgtaagtgactggagttcagacgtgtgctcttcc

SEQ ID NO: 4371 - DNA, 61 bp, Artificial Sequence
  PCR2_Rvs_v2_031
caagcagaagacggcatacgagatagaatgccgtgactggagttcagacgtgtgctcttcc

SEQ ID NO: 4372 - DNA, 61 bp, Artificial Sequence
  PCR2_Rvs_v2_032
caagcagaagacggcatacgagatgaggcattgtgactggagttcagacgtgtgctcttcc

SEQ ID NO: 4373 - DNA, 61 bp, Artificial Sequence
  PCR2_Rvs_v2_033
caagcagaagacggcatacgagatcctcggtagtgactggagttcagacgtgtgctcttcc

SEQ ID NO: 4374 - DNA, 61 bp, Artificial Sequence
  PCR2_Rvs_v2_034
caagcagaagacggcatacgagatttctaacggtgactggagttcagacgtgtgctcttcc

SEQ ID NO: 4375 - DNA, 61 bp, Artificial Sequence
  PCR2_Rvs_v2_035
caagcagaagacggcatacgagatatgaggctgtgactggagttcagacgtgtgctcttcc

SEQ ID NO: 4376 - DNA, 61 bp, Artificial Sequence
  PCR2_Rvs_v2_036
caagcagaagacggcatacgagatgcagaatcgtgactggagttcagacgtgtgctcttcc

SEQ ID NO: 4377 - DNA, 61 bp, Artificial Sequence
  PCR2_Rvs_v2_037
caagcagaagacggcatacgagatcactacgagtgactggagttcagacgtgtgctcttcc

SEQ ID NO: 4378 - DNA, 61 bp, Artificial Sequence
  PCR2_Rvs_v2_038
caagcagaagacggcatacgagattgtcgtaggtgactggagttcagacgtgtgctcttcc

SEQ ID NO: 4379 - DNA, 61 bp, Artificial Sequence
  PCR2_Rvs_v2_039
caagcagaagacggcatacgagataccacttagtgactggagttcagacgtgtgctcttcc

SEQ ID NO: 4380 - DNA, 61 bp, Artificial Sequence
  PCR2_Rvs_v2_040
caagcagaagacggcatacgagatgttgtccggtgactggagttcagacgtgtgctcttcc

SEQ ID NO: 4381 - DNA, 61 bp, Artificial Sequence
  PCR2_Rvs_v2_041
caagcagaagacggcatacgagatatccatatgtgactggagttcagacgtgtgctcttcc

SEQ ID NO: 4382 - DNA, 61 bp, Artificial Sequence
  PCR2_Rvs_v2_042
caagcagaagacggcatacgagatgcttgcgcgtgactggagttcagacgtgtgctcttcc

SEQ ID NO: 4383 - DNA, 61 bp, Artificial Sequence
  PCR2_Rvs_v2_043
caagcagaagacggcatacgagatagtatcttgtgactggagttcagacgtgtgctcttcc

SEQ ID NO: 4384 - DNA, 61 bp, Artificial Sequence
  PCR2_Rvs_v2_044
caagcagaagacggcatacgagatgacgctccgtgactggagttcagacgtgtgctcttcc

SEQ ID NO: 4385 - DNA, 61 bp, Artificial Sequence
  PCR2_Rvs_v2_045
caagcagaagacggcatacgagatcatgccatgtgactggagttcagacgtgtgctcttcc

SEQ ID NO: 4386 - DNA, 61 bp, Artificial Sequence
  PCR2_Rvs_v2_046
caagcagaagacggcatacgagattgcattgcgtgactggagttcagacgtgtgctcttcc

SEQ ID NO: 4387 - DNA, 61 bp, Artificial Sequence
  PCR2_Rvs_v2_047
caagcagaagacggcatacgagatattggaacgtgactggagttcagacgtgtgctcttcc

SEQ ID NO: 4388 - DNA, 61 bp, Artificial Sequence
  PCR2_Rvs_v2_048
caagcagaagacggcatacgagatgccaaggtgtgactggagttcagacgtgtgctcttcc

SEQ ID NO: 4389 - DNA, 58 bp, Artificial Sequence
  PCR2_fwd_v1_univ
aatgatacggcgaccaccgagatctacactctttccctacacgacgctcttccgatct

SEQ ID NO: 4390 - DNA, 52 bp, Artificial Sequence; identical to SEQ ID NO: 3621
  PCR2_fwd_v2_univ

SEQ ID NO: 4391 - DNA, 64 bp, Artificial Sequence
  PCR2_fwd_v2_001
aatgatacggcgaccaccgagatctacacagcgctagacactctttccctacacgacgctcttc

SEQ ID NO: 4392 - DNA, 64 bp, Artificial Sequence
  PCR2_fwd_v2_002
aatgatacggcgaccaccgagatctacacgatatcgaacactctttccctacacgacgctcttc

SEQ ID NO: 4393 - DNA, 64 bp, Artificial Sequence
  PCR2_fwd_v2_003
aatgatacggcgaccaccgagatctacaccgcagacgacactctttccctacacgacgctcttc

SEQ ID NO: 4394 - DNA, 64 bp, Artificial Sequence
  PCR2_fwd_v2_004
aatgatacggcgaccaccgagatctacactatgagtaacactctttccctacacgacgctcttc

SEQ ID NO: 4395 - DNA, 64 bp, Artificial Sequence
  PCR2_fwd_v2_005
aatgatacggcgaccaccgagatctacacaggtgcgtacactctttccctacacgacgctcttc

SEQ ID NO: 4396 - DNA, 64 bp, Artificial Sequence
  PCR2_fwd_v2_006
aatgatacggcgaccaccgagatctacacgaacatacacactctttccctacacgacgctcttc

SEQ ID NO: 4397 - DNA, 64 bp, Artificial Sequence
  PCR2_fwd_v2_007
aatgatacggcgaccaccgagatctacacacatagcgacactctttccctacacgacgctcttc

SEQ ID NO: 4398 - DNA, 64 bp, Artificial Sequence
  PCR2_fwd_v2_008
aatgatacggcgaccaccgagatctacacgtgcgataacactctttccctacacgacgctcttc

SEQ ID NO: 4399 - DNA, 64 bp, Artificial Sequence
  PCR2_fwd_v2_009
aatgatacggcgaccaccgagatctacacccaacagaacactctttccctacacgacgctcttc

SEQ ID NO: 4400 - DNA, 64 bp, Artificial Sequence
  PCR2_fwd_v2_010
aatgatacggcgaccaccgagatctacacttggtgagacactctttccctacacgacgctcttc

SEQ ID NO: 4401 - DNA, 64 bp, Artificial Sequence
  PCR2_fwd_v2_011
aatgatacggcgaccaccgagatctacaccgcggttcacactctttccctacacgacgctcttc

SEQ ID NO: 4402 - DNA, 64 bp, Artificial Sequence
  PCR2_fwd_v2_012
aatgatacggcgaccaccgagatctacactataacctacactctttccctacacgacgctcttc

SEQ ID NO: 4403 - RNA, 26 nt, Artificial Sequence
  stem loop sequence
  misc_feature (4)..(23): n is any ribonucleotide
  misc_feature (7)..(23): These individual nucleotides may be absent
uuunnnnnnnnnnnnnnnnnnnnuuu

SEQ ID NO: 4404 - DNA, 60 bp, Artificial Sequence
  PAM cleavage assay DNA substrate
agcgcgagcacagctaaggccacggagcgagacatctcggcccgaatgctgtcagcttca

SEQ ID NO: 4405 - DNA, 60 bp, Artificial Sequence; identical to SEQ ID NO: 3567
  PAM cleavage assay DNA substrate

SEQ ID NO: 4406 - DNA, 60 bp, Artificial Sequence
  PAM cleavage assay DNA substrate
agcgcgagcacagctaaggccacggagcgagacatctcggcccgagtgctgtcagcttca

SEQ ID NO: 4407 - DNA, 60 bp, Artificial Sequence
  PAM cleavage assay DNA substrate
tgaagctgacagcactcgggccgagatgtctcgctccgtggccttagctgtgctcgcgct

SEQ ID NO: 4408 - DNA, 60 bp, Artificial Sequence
  PAM cleavage assay DNA substrate
agcgcgagcacagctaaggccacggagcgagacatctcggcccgactgctgtcagcttca

SEQ ID NO: 4409 - DNA, 60 bp, Artificial Sequence
  PAM cleavage assay DNA substrate
tgaagctgacagcagtcgggccgagatgtctcgctccgtggccttagctgtgctcgcgct

SEQ ID NO: 4410 - DNA, 60 bp, Artificial Sequence
  PAM cleavage assay DNA substrate
agcgcgagcacagctaaggccacggagcgagacatctcggcccgattgctgtcagcttca

SEQ ID NO: 4411 - DNA, 60 bp, Artificial Sequence
  PAM cleavage assay DNA substrate
tgaagctgacagcaatcgggccgagatgtctcgctccgtggccttagctgtgctcgcgct

SEQ ID NO: 4412 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 4413 - protein, 986 aa, Artificial Sequence; identical to SEQ ID NO: 254
  CasX variant

SEQ ID NO: 4414 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 4415 - protein, 972 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

What is claimed is:

1. An engineered protein comprising a RuvC cleavage domain, wherein the RuvC cleavage domain comprises the sequence of amino acids 648-812 of SEQ ID NO: 2 with one or more amino acid modifications relative to said RuvC cleavage domain sequence, and
wherein the engineered protein exhibits one or more improved characteristics compared to SEQ ID NO: 2 selected from the group consisting of improved editing of target DNA, improved target DNA cleavage rate, increased formation of cleavage-competent ribonucleoprotein (RNP) complexes, improved protospacer adjacent motif (PAM) utilization, and improved solubility.

2. The engineered protein of claim 1, wherein the one or more amino acid modifications comprise a modification at a position selected from the group consisting of I658, A708, and P793.

3. The engineered protein of claim 1, wherein the one or more amino acid modifications comprise an amino acid substitution.

4. The engineered protein of claim 3, wherein the substitution is a substitution at amino acid position A708, or is a substitution at amino acid position I658.

5. The engineered protein of claim 4, wherein the substitution is A708K.

6. The engineered protein of claim 4, wherein the substitution is I658V.

7. The engineered protein of claim 1, wherein the one or more amino acid modifications comprise an amino acid deletion.

8. The engineered protein of claim of claim 7, wherein the deletion is at amino acid position P793.

9. The engineered protein of claim 1, further comprising amino acids 922-978 of a RuvC DNA cleavage domain of SEQ ID NO: 2, or a sequence having at least 70% sequence identity thereto.

10. The engineered protein of claim 1, further comprising one or more of:
(a) a non-target strand binding (NTSB) domain;
(b) a target strand loading (TSL) domain;
(c) a helical I domain;
(d) a helical II domain; and
(e) an oligonucleotide binding domain (OBD).

11. The engineered protein of claim 1, comprising a NTSB domain, wherein the NTSB domain comprises amino acids 101-191 of SEQ ID NO: 1, or a sequence having at least 70% sequence identity thereto.

12. The engineered protein of claim 1, comprising a TSL domain, wherein the TSL domain comprises amino acids 813-921 of SEQ ID NO: 2, or a sequence having at least 70% sequence identity thereto.

13. The engineered protein of claim 1, comprising a helical I domain, wherein the helical I domain is a chimeric helical I domain derived from the helical I domain sequences of SEQ ID NO: 1 and SEQ ID NO: 2.

14. The engineered protein of claim 13, wherein the chimeric helical I domain comprises amino acids 59-102 of SEQ ID NO: 2, or a sequence having at least 70% sequence identity thereto, and comprises amino acids 192-332 of SEQ ID NO: 1, or at least 70% sequence identity thereto.

15. The engineered protein of claim 1, comprising a helical II domain, wherein the helical II domain comprises amino acids 334-501 of SEQ ID NO: 2, or a sequence having at least 70% sequence identity thereto.

16. The engineered protein of claim 15, wherein the helical II domain comprises a substitution at amino acid position L379 of SEQ ID NO: 2.

17. The engineered protein of claim 16, wherein the substitution is L379R.

18. The engineered protein of claim 15, wherein the helical II domain comprises a substitution at amino acid position F399 of SEQ ID NO: 2.

19. The engineered protein of claim 18, wherein the substitution is F399L.

20. The engineered protein of claim 1, comprising an OBD, wherein the OBD comprises amino acids 1-58 of SEQ ID NO: 2, or a sequence having at least 70% sequence identity thereto, and comprises amino acids 502-647 of SEQ ID NO: 2, or at least 70% sequence identity thereto.

21. The engineered protein of claim 1, comprising:
(a) a non-target strand binding (NTSB) domain;
(b) a target strand loading (TSL) domain;
(c) a chimeric helical I domain;
(d) a helical II domain;
(e) an oligonucleotide binding domain (OBD); and
(f) a RuvC DNA cleavage domain,
wherein the engineered protein is a chimeric protein,
wherein the NTSB domain comprises the amino acids of positions 101-191 of SEQ ID NO: 1, or a sequence with at least 70% sequence identity thereto;
wherein the TSL domain comprises the amino acids of positions 813-921 of SEQ ID NO: 2, or a sequence with at least 70% sequence identity thereto;
wherein the helical II domain comprises the amino acids of positions 334-501 of SEQ ID NO: 2, or a sequence with at least 70% sequence identity thereto;
wherein the OBD domain comprises the amino acids of positions 1-58 of SEQ ID NO: 2, or a sequence with at least 70% sequence identity thereto;
and wherein the RuvC DNA cleavage domain comprises the amino acids of positions 648-812 and 922-978 of SEQ ID NO: 2, or sequences with at least 70% sequence identity thereto.

22. The engineered protein of claim 21, comprising:
(a) a RuvC DNA cleavage domain comprising a substitution at amino acid position I658 of SEQ ID NO: 2;
(b) a RuvC DNA cleavage domain comprising a substitution at amino acid position A708 of SEQ ID NO: 2;
(c) a helical II domain comprising a substitution at amino acid position L379 of SEQ ID NO: 2; and/or
(d) a helical II domain comprising a substitution at amino acid position F399 of SEQ ID NO: 2.

23. The engineered protein of claim 22, wherein the chimeric helical I domain comprises amino acids 59-102 of SEQ ID NO: 2, or a sequence having at least 70% sequence identity thereto, and comprises amino acids 192-332 of SEQ ID NO: 1, or a sequence having at least 70% sequence identity thereto.

24. The engineered protein of claim 23, comprising:
(a) a RuvC DNA cleavage domain comprising an amino acid substitution of I658V;
(b) a RuvC DNA cleavage domain comprising an amino acid substitution of A708K;
(c) a RuvC DNA cleavage domain comprising a deletion at amino acid position P793;
(d) a helical II domain comprising an amino acid substitution of L379R; and
(e) a helical II domain comprising an amino acid substitution of F399L.

25. The engineered protein of claim 1, wherein the protein is selected from the group consisting of SEQ ID NO: 3505, SEQ ID NO: 3506, SEQ ID NO: 3507, and SEQ ID NO:

3548, or a protein comprising a sequence having at least 70% sequence identity thereto.

\* \* \* \* \*